US009198975B2

(12) United States Patent
Patterson et al.

(10) Patent No.: US 9,198,975 B2
(45) Date of Patent: Dec. 1, 2015

(54) METHODS AND COMPOSITIONS FOR TARGETING SITES OF NEOVASCULAR GROWTH

(75) Inventors: Cam Patterson, Chapel Hill, NC (US); Anka N. Veleva, Cary, NC (US)

(73) Assignees: The University of North Carolina at Chapel Hill, Chapel Hill, NC (US); North Carolina State University, Raleigh, NC (US)

( * ) Notice: Subject to any disclaimer, the term of this patent is extended or adjusted under 35 U.S.C. 154(b) by 0 days.

(21) Appl. No.: 13/990,932

(22) PCT Filed: Dec. 1, 2011

(86) PCT No.: PCT/US2011/062822
§ 371 (c)(1),
(2), (4) Date: Sep. 5, 2013

(87) PCT Pub. No.: WO2012/075243
PCT Pub. Date: Jun. 7, 2012

(65) Prior Publication Data
US 2014/0004040 A1 Jan. 2, 2014

Related U.S. Application Data

(60) Provisional application No. 61/418,646, filed on Dec. 1, 2010.

(51) Int. Cl.
*G01N 33/574* (2006.01)
*A61K 38/04* (2006.01)
*A61K 47/48* (2006.01)
*C07K 7/08* (2006.01)
*A61K 51/08* (2006.01)
*A61B 5/00* (2006.01)

(52) U.S. Cl.
CPC ........... *A61K 47/48246* (2013.01); *A61K 38/04* (2013.01); *A61K 51/088* (2013.01); *C07K 7/08* (2013.01); *A61B 5/0071* (2013.01); *A61B 5/0075* (2013.01); *G01N 33/57484* (2013.01); *G01N 2500/00* (2013.01); *G01N 2500/10* (2013.01); *G01N 2800/7014* (2013.01)

(58) Field of Classification Search
None
See application file for complete search history.

(56) References Cited

U.S. PATENT DOCUMENTS

| 5,679,339 | A  | 10/1997 | Keith et al. |
| 5,980,887 | A  | 11/1999 | Isner et al. |
| 7,261,881 | B1 | 8/2007  | Sierra-Honigmann |
| 8,426,367 | B2 | 4/2013  | Patterson et al. |
| 2009/0076481 | A1 | 3/2009 | Stegmann et al. |
| 2010/0119476 | A1 | 5/2010 | Patterson et al. |
| 2010/0190703 | A1 | 7/2010 | Patterson et al. |

FOREIGN PATENT DOCUMENTS

| EP | 2 108 698 A1 | 10/2009 |
| WO | WO 03/037172 A2 | 5/2003 |
| WO | WO 2005/078073 A2 | 8/2005 |
| WO | WO 2006/086822 A1 | 8/2006 |
| WO | WO 2008/109653 A2 | 9/2008 |
| WO | WO 2008109653 A2 * | 9/2008 |

OTHER PUBLICATIONS

Balestrieri, M.L. and Napoli C., "Novel challenges in exploring peptide ligands and corresponding tissue-specific endothelial receptors," *European Journal of Cancer*, 2007, vol. 43, No. 8, pp. 1242-1250.
Bowie, J.U., et al., "Deciphering the Message in Protein Sequences: Tolerance to Amino Acid Substitutions," *Science*, 1990, vol. 247, pp. 1306-1310.
Bussolati, B., et al., "Targeting of human renal tumor-derived endothelial cells with peptides obtained by phage display," *J Mol Med*, 2007, vol. 85, No. 8, pp. 897-906.
Chakroborty, D., et al., "Dopamine regulates endothelial progenitor cell mobilization from mouse bone marrow in tumor vascularization," *The Journal of Clinical Investigation*, 2008, vol. 118, No. 4, pp. 1380-1389.
Duda, D.G., et al., "A protocol for phenotypic detection and enumeration of circulating endothelial cells and circulating progenitor cells in human blood," *Nat Protocols*, 2007, vol. 2, No. 4, pp. 805-810.
Eggermann, J., et al., "Endothelial progenitor cell culture and differentiation in vitro: a methodological comparison using human umbilical cord blood," *Cardiovascular Research*, 2003, vol. 58, No. 2, pp. 478-486. endothelial progenitor cell angiogenesis in vitro," *J Cereb Blood Flow Metab*, 2008, vol. 28, pp. 90-98.
Friedrich, E.B., et al., "CD34-/CD133+VEGFR-2+Endothelial Progenitor Cell Subpopulation With Potent Vasoregenerative Capacities," *Circ Res*, 2006, vol. 98, e20-e25.
Fürstenberger, G., et al., "Circulating endothelial cells and angiogenic serum factors during neoadjuvant chemotherapy of primary breast cancer," *Br J Cancer*, 2006, vol. 94, pp. 524-531.
Hajitou, A., et al., "Vascular Targeting: Recent Advances and Therapeutic Perspectives," *Trends in Cardiovascular Medicine*, 2006, vol. 16, No. 3, pp. 80-88.

(Continued)

*Primary Examiner* — Julie Ha
*Assistant Examiner* — Kristina M Hellman
(74) *Attorney, Agent, or Firm* — Alston & Bird LLP

(57) ABSTRACT

Compositions and methods for targeted delivery to and detection of sites of neovascular growth, including tumor vasculature, are provided. Compositions include polypeptides conjugated to or complexed with a bioactive compound, wherein the polypeptide is capable of binding to an OEC or a circulating progenitor thereof. Methods for identifying additional polypeptides with the same binding characteristics are further provided. Methods for targeted delivery of a bioactive compound to a site of neovascular growth are provided in which polypeptides capable of binding OECs or progenitors thereof are conjugated to or complexed with the bioactive compound and administered to a subject in need thereof. Methods for detecting neovascular growth are also provided, wherein the polypeptides conjugated to or complexed with a detectable label are administered to a subject and the label is detected.

16 Claims, 6 Drawing Sheets

(56) References Cited

OTHER PUBLICATIONS

Fan, Y., et al., "Interleukin-6 stimulates circulating blood-derived
Hardy, B., et al., "Angiogenesis induced by novel peptides selected from a phage display library by screening human vascular endothelial cells under different physiological conditions," *Peptides*, 2007, vol. 28, No. 3, pp. 691-701.
Kim, S.-Y., et al., "RGD-peptide presents anti-adhesive effect, but not direct pro-apoptotic effect on endothelial progenitor cells," *Archives of Biochemistry and Biophysics*, 2007, vol. 459, No. 1, pp. 40-49.
Liang, S., et al., "Screening and identification of vascular-endothelial-cell-specific binding peptide in gastric cancer," *J Mol Med*, 2006, vol. 84, No. 9, pp. 764-773.
Lin, Y., et al., "Origins of circulating endothelial cells and endothelial outgrowth from blood," *The Journal of Clinical Investigation*, 2000, vol. 105, No. 1, pp. 71-77.
Lin, Y., et al., "Use of blood outgrowth endothelial cells for gene therapy for hemophilia A," *Blood*, 2002, vol. 99, No. 2, pp. 457-462.
Mallat, Z., et al., "Interleukin-18/Interleukin-18 Binding Protein Signaling Modulates Ischemia-Induced Neovascularization in Mice Hindlimb," *Circ Res*, 2002, vol. 91, pp. 441-448.
Ngo, J.-T., et al., Chapter 14 "Computational Complexity, Protein Structure Prediction, and the Leviathal Paradox," *The Protein Folding Problem and Tertiary Structure Prediction*, 1994, Merz, et al., eds, Birkhäuser Boston, pp. 433-506.
Povsic, T.J., et al., "Circulating Progenitor Cells Can Be Reliably Identified on the Basis of Aldehyde Dehydrogenase Activity," *J Am Coll Cardiol*, 2007, vol. 50, No. 23, pp. 2243-2248.
Rafii, S., et al., "Efficient mobilization and recruitment of marrow-derived endothelial and hematopoietic stem cells by adenoviral vectors expressing angiogenic factors," *Gene Therapy*, 2002, vol. 9, pp. 631-641.

Rosell, A., et al., "Interleukin-1 β augments angiogenic responses of murine endothelial progenitor cells in vitro," *J Cereb Blood Flow Metab*, 2009, vol. 29, pp. 933-943.
Schluesener, H.J. and Xianglin, T., "Selection of recombinant phages binding to pathological endothelial and tumor cells of rat glioblastoma by in-vivo display," *J Neurol Sci*, 2004, vol. 224, No. 1-2, pp. 77-82.
Veleva, A.N., et al., "Selection and Initial Characterization of Novel Peptide Ligands That Bind Specifically to Human Blood Outgrowth Endothelial Cells," *Biotech Bioeng*, 2007, vol. 98, No. 1, pp. 306-312.
Veleva, A.N., et al., "Selective endothelial cell attachment to peptide-modified terpolymers," *Biomaterials*, 2008, vol. 29, pp. 3656-3661.
Veleva, A.N., et al., "Efficient In Vivo Selection of a Novel Tumor-Associated Peptide from a Phage Display Library," *Molecules*, 2011, vol. 16, pp. 900-914.
Wang, D., et al., "A Single Amino Acid Determines Lysophospholipid Specificity of the $S1P_1$ (EDG1) and $LPA_1$ (EDG2) Phospholipid Growth Factor Receptors," *J Biol Chem*, 2001, vol. 276, No. 52, pp. 49213-49220.
Wang, H., et al., "Wnt2 Coordinates the Commitment of Mesoderm to Hematopoietic, Endthelial, and Cardiac Lineages in Embryoid Bodies," *J Biol Chem*, 2007, vol. 282, No. 1, pp. 782-791.
Wei, J., et al., "Human blood late outgrowth endothelial cells for gene therapy of cancer: determinants of efficacy," *Gene Therapy*, 2007, vol. 14, pp. 344-356.
Wells, J.A., "Additivity of Mutational Effects in Proteins," *Perspectives in Biochemistry*, 1990, vol. 29, No. 37, pp. 8509-8517.
Partial ESR for EP Appl. No. 13173832, pp. 1-6, mailed Jan. 8, 2014.
Ph.D.™-12 Phage Display Peptide Library Kit; New England BioLabs, Inc., pp. 1-5; https://www.neb.com/products/e8110-phd-12-phage-display-peptide-library-kit, downloaded from world wide web on Jun. 19, 2015.

\* cited by examiner

METHODS AND COMPOSITIONS FOR TARGETING SITES OF NEOVASCULAR GROWTH

CROSS REFERENCE TO RELATED APPLICATIONS

This application is a U.S. National Stage Application based on PCT/US2011/062822, filed Dec. 1, 2011, which claims the benefit of U.S. Provisional Application No. 61/418,646, filed on Dec. 1, 2010, each of which is herein incorporated by reference in its entirety.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named amended434073SEQLIST.TXT, created on Sep. 5, 2013, and having a size of 743 kilobytes and is filed with the Preliminary Amendment filed on Sep. 5, 2013. The sequence listing contained in this ASCII formatted document is part of the specification and is herein incorporated by reference in its entirety.

FIELD OF THE INVENTION

The present invention relates to methods and compositions for targeted delivery to and detection of sites of neovascular growth, including tumor vasculature, using polypeptides specific for blood outgrowth endothelial cells or circulating progenitors thereof.

BACKGROUND OF THE INVENTION

Angiogenesis is the process of new blood vessel development from preexisting vasculature. Angiogenesis is a normal process in growth and development, as well as in wound healing. Vasculogenesis is the process of blood vessel formation from endothelial progenitor cells (EPC) that differentiate in situ.

Until recently, vasculogenesis was thought to be limited to embryologic development. However, the discovery of circulating endothelial progenitor cells has provided evidence that postnatal vasculogenesis also occurs in adults. Neovascular growth, including angiogenesis and vasculogenesis, can contribute to various disease states, including many cancers (Rafii et al. (2002) *Nature Reviews Cancer* 2(11):826-835). New tumor-associated blood vessels provide blood flow that allows for the further growth of the tumor and provide a pathway by which tumor cells can metastasize.

The ability to target vasculature for imaging (e.g., for diagnosing or monitoring cancer) or drug delivery purposes has been an elusive goal. Therefore, novel methods and compositions for targeting sites of neovascular growth are needed.

BRIEF SUMMARY OF THE INVENTION

Compositions and methods are provided that are directed to targeting and detecting sites of neovascular growth. The compositions include novel nucleotide and amino acid sequences for polypeptides that bind to blood outgrowth endothelial cells (OEC) or circulating progenitors thereof and kits comprising the same. Further compositions include polypeptides conjugated to or complexed with a bioactive compound (e.g., a drug, a detectable label), wherein the polypeptide is capable of binding to OEC or a circulating progenitor thereof. Such polypeptides can be used in methods for delivering a bioactive compound to a site of neovascular growth through the administration of the polypeptides conjugated to or complexed with a bioactive compound to a subject in need thereof. The polypeptides also find use in detecting neovascular growth via the administration of the polypeptides conjugated to or complexed with a detectable label to a subject followed by detection of the label.

Further provided are methods for identifying additional polypeptides that can be used to target or detect neovascular growth.

The following embodiments are encompassed by the present invention:

1. A method for delivering a bioactive compound to a site of neovascular growth, said method comprising administering an effective amount of a polypeptide capable of binding outgrowth endothelial cells (OEC) or a circulating progenitor thereof to a subject in need thereof, wherein said polypeptide is conjugated to or complexed with said bioactive compound, wherein said polypeptide comprises an amino acid sequence selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, and 55, and variants thereof, wherein said variant has at least 80% sequence identity across the entirety of any one of SEQ ID NOs: 1-55, and wherein said variant retains the ability to bind OEC or a circulating progenitor thereof.

2. The method of embodiment 1, wherein said polypeptide has the sequence set forth in SEQ ID NO: 25, 26, or 41.

3. The method of embodiment 1, wherein said neovascular growth is associated with a tumor.

4. The method of embodiment 3, wherein said bioactive compound is therapeutically effective against said tumor.

5. The method of any one of embodiments 1-4, wherein said bioactive compound is an angiogenesis inhibitor or a chemotherapeutic drug.

6. A method for detecting neovascular growth, said method comprising:
   a) administering an effective amount of a polypeptide capable of binding outgrowth endothelial cells (OEC) or a circulating progenitor thereof to a subject, wherein said polypeptide is conjugated to or complexed with a detectable label, wherein said polypeptide comprises an amino acid sequence selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, and 55, and variants thereof, wherein said variant has at least 80% sequence identity across the entirety of any one of SEQ ID NOs: 1-55, and wherein said variant retains the ability to bind OEC or a circulating progenitor thereof; and
   b) detecting said detectable label.

7. The method of embodiment 6, wherein the polypeptide has the sequence set forth in SEQ ID NO: 25, 26, or 41.

8. The method of embodiment 6, wherein said neovascular growth is associated with a tumor.

9. The method of embodiment 3, 4, or 8, wherein said tumor is a lung carcinoma.

10. The method of any one of embodiments 6-9, wherein said detectable label is a fluorophore, a radionuclide, an ultrasound contrast agent, or a paramagnetic compound.

11. The method of embodiment 10, wherein said radionuclide is a positron-emitting radionuclide.

12. The method of embodiment 11, wherein said positron-emitting radionuclide is carbon-11, nitrogen-13, oxygen-15, fluorine-18, or copper-64.

13. The method of embodiment 11 or 12, wherein the detectable label is detected using positron emission tomography.

14. The method of embodiment 10, wherein said paramagnetic compound is gadolinium.

15. The method of embodiment 14, wherein the detectable label is detected using magnetic resonance imaging.

16. The method of any one of embodiments 1-15, wherein said polypeptide has the sequence set forth in SEQ ID NO: 26.

17. The method of any one of embodiments 1-16, wherein said polypeptide is on the surface of a filamentous phage.

18. The method of embodiment 17, wherein said filamentous phage is a M13 phage.

19. The method of embodiment 18, wherein said polypeptide is fused to a pIII minor coat protein of the M13 phage.

20. The method of embodiment 18, wherein said polypeptide is complexed with said bioactive compound or said detectable label via a linkage between said bioactive compound or said detectable label and a pVIII protein on said M13 phage.

21. The method of embodiment 20, wherein said bioactive compound or said detectable label is linked to said pVIII protein via 1,4,7,10-tetraazacyclododecane-N,N',N'',N'''-tetraacetic acid (DOTA).

22. The method of any one of embodiments 1-21, wherein said subject is a mammal.

23. The method of embodiment 22, wherein said mammal is a human.

24. A composition comprising a polypeptide capable of binding outgrowth endothelial cells (OEC) or a circulating progenitor thereof conjugated to or in complex with a bioactive compound or a detectable label, wherein said polypeptide comprises an amino acid sequence selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, and 55, and variants thereof, wherein said variant has at least 80% sequence identity across the entirety of any one of SEQ ID NOs: 1-55, and wherein said variant retains the ability to bind OEC or a circulating progenitor thereof.

25. The composition of embodiment 24, wherein said detectable label is a fluorophore, a radionuclide, an ultrasound contrast agent, or a paramagnetic compound.

26. The composition of embodiment 25, wherein said radionuclide is a positron-emitting radionuclide.

27. The composition of embodiment 26, wherein said positron-emitting radionuclide is carbon-11, nitrogen-13, oxygen-15, fluorine-18, or copper-64.

28. The composition of embodiment 25, wherein said paramagnetic compound is gadolinium.

29. The composition of embodiment 24, wherein said bioactive compound is an angiogenesis inhibitor or a chemotherapeutic drug.

30. The composition of any one of embodiments 24-29, wherein said polypeptide has the sequence set forth in SEQ ID NO: 26.

31. The composition of any one of embodiments 24-30, wherein said polypeptide is on the surface of a filamentous phage.

32. The composition of embodiment 31, wherein said filamentous phage is a M13 phage.

33. The composition of embodiment 32, wherein said polypeptide is fused to a pIII minor coat protein of the M13 phage.

34. The composition of embodiment 32, wherein said polypeptide is complexed with said bioactive compound or said detectable label via a linkage between said bioactive compound or said detectable label and a pVIII protein on said M13 phage.

35. The composition of embodiment 34, wherein said bioactive compound or said detectable label is linked to said pVIII protein via 1,4,7,10-tetraazacyclododecane-N,N',N'',N'''-tetraacetic acid (DOTA).

36. The composition of any one of embodiments 24-35, further comprising a pharmaceutically acceptable carrier.

37. An isolated polypeptide capable of binding outgrowth endothelial cells (OEC) or a circulating progenitor thereof wherein said polypeptide comprises an amino acid sequence selected from the group consisting of SEQ ID NO: 40, 41, 42, 43, 44, 45, 46, 47, 48, 49, 50, 51, 52, 53, 54, and 55, and variants thereof, wherein said variant has at least 80% sequence identity across the entirety of any one of SEQ ID NOs: 40-55, and wherein said variant retains the ability to bind OEC or a circulating progenitor thereof.

38. The isolated polypeptide of embodiment 37, wherein said polypeptide has from about 8 to about 30 amino acids.

39. The isolated polypeptide of embodiment 37, wherein said polypeptide contains at least one motif selected from the group consisting of PLR, PPR, TP, TPT, TPS, TPG, PPS, and MPT.

40. An isolated nucleic acid molecule having a nucleotide sequence that encodes at least one of the polypeptides of any one of embodiments 37-39.

41. A vector comprising the nucleic acid molecule of embodiment 40.

42. A kit comprising at least one of the polypeptides of any one of embodiments 37-39.

43. A composition comprising at least one polypeptide for use in a method of sequestering and retaining OEC at a therapeutic site of interest, said method comprising introducing at said therapeutic site the at least one polypeptide, wherein said polypeptide comprises an amino acid sequence selected from the group consisting of SEQ ID NO: 40, 41, 42, 43, 44, 45, 46, 47, 48, 49, 50, 51, 52, 53, 54, and 55, and variants thereof, wherein said variant has at least 80% sequence identity across the entirety of any one of SEQ ID NOs: 40-55 and wherein said variant retains the ability to bind OEC.

44. The composition of embodiment 43, wherein said polypeptide is bound to an OEC.

45. The composition of embodiment 43 or 44, wherein said therapeutic site of interest is selected from the group consisting of an area where angiogenesis is desired, an area of ischemic injury, an area of organ transplantation, and an area of vascular injury.

46. A method for sequestering and retaining outgrowth endothelial cells (OEC) at a therapeutic site of interest, said method comprising introducing at said therapeutic site at least one polypeptide wherein said polypeptide comprises an amino acid sequence selected from the group consisting of SEQ ID NO: 40, 41, 42, 43, 44, 45, 46, 47, 48, 49, 50, 51, 52, 53, 54, and 55, and variants thereof, wherein said variant has at least 80% sequence identity across the entirety of any one of SEQ ID NOs: 40-55 and wherein said variant retains the ability to bind OEC.

47. The method of embodiment 46, wherein said polypeptide has from about 8 to about 30 amino acids.

48. The method of embodiment 46, wherein said polypeptide contains at least one motif selected from the group consisting of PLR, PPR, TP, TPT, TPS, TPG, PPS, and MPT.

49. The method of any of embodiments 46-48, wherein said polypeptide is bound to an OEC.

50. The method of any one of embodiments 46-49, wherein said therapeutic site of interest is selected from the group consisting of an area where angiogenesis is desired, an area of ischemic injury, an area of organ transplantation, and an area of vascular injury.

51. A method for identifying a polypeptide that specifically binds an outgrowth endothelial cell (OEC) or a circulating progenitor thereof, said method comprising:
  i) obtaining a polypeptide library;
  ii) contacting said polypeptide library with non-OEC cells and removing said non-OEC cells and bound polypeptides, and retaining unbound polypeptides;
  iii) contacting said unbound polypeptides with OEC to allow any polypeptides to bind;
  iv) eluting polypeptides that bind to OEC and retaining eluted polypeptides;
  v) contacting said eluted polypeptides with bone marrow (BM) cells to allow any eluted polypeptides to bind and retaining polypeptide-bound BM cells;
  vi) administering polypeptide-bound BM cells to a subject having a tumor to allow said polypeptide-bound BM cells to localize to said tumor;
  vii) isolating said polypeptides that have localized to said tumor; and
  viii) identifying tumor-localized polypeptides.

52. The method of embodiment 51, wherein said polypeptide library is a filamentous phage polypeptide library.

53. The method of embodiment 52, wherein said filamentous phage polypeptide library is a M13 phage polypeptide library.

54. The method of any one of embodiments 51-53, wherein said non-OEC cells are human umbilical vein endothelial cells.

These and other aspects of the invention are disclosed in more detail in the description of the invention given below.

BRIEF DESCRIPTION OF THE FIGURES

FIG. 2A depicts a schematic of the in vitro pre-selection of a random 12-mer peptide library on human umbilical vein endothelial cells (one round of negative selection) and on human blood outgrowth endothelial cells (three rounds of positive selection) as previously described (Veleva et al. (2007) *Biotechnology and Bioengineering* 98(1): 306-312). This resulted in an enriched phage pool, designated as mini-library. The mini-library was used for subsequent in vivo panning of tumor-associated phage employing two distinct selection schemes.

FIG. 2B depicts a schematic of the i.v. injection of the mini-library into a Lewis lung carcinoma (LLC) tumor bearing mouse. Phage were allowed to circulate for 2 hours and the mouse was perfused with PBS. Then, the tumor was excised, the tumor-bound phage pool was amplified in *E. Coli*, and used for another round of biopanning A total of three in vivo selection cycles were conducted utilizing free phage.

FIG. 2C depicts a schematic of the labeling of freshly isolated bone marrow (BM) cells with the mini-library. BM-bound phage were injected i.v. into the tail vein of a LLC tumor bearing mouse. After 2 hours of circulation, the mouse was perfused with PBS. The phage were rescued from the tumor, amplified, and used to label BM cells for subsequent enrichment cycles. Three rounds of in vivo functional selection were performed using BM-bound phage.

FIG. 2D shows the homing efficiency of the phage pool from each selection cycle, calculated as the ratio of output phage titer to input phage titer multiplied by 100. Using BM cells to deliver phage to tumors improves the efficiency of the selection procedure in the range of 50-fold. The open bars for each round represent free phage and the closed bars represent BM-bound phage. The bars show standard error of the mean (s.e.m.) from plating quadruplicates. P values were calculated by Student's t-test and were considered statistically significant at $P<0.05$.

FIG. 4A shows representative coronal microPET images of mice bearing LLC tumors. Images were acquired 18 hours post-injection of 800 μCi of $^{64}$Cu-DOTA, $^{64}$Cu-DOTA-control non-targeted phage, or $^{64}$Cu-DOTA-QFP-targeted phage.

FIG. 4B shows the standard uptake values calculated from the coronal PET images in tumor (mean±s.e.m., n=3). P values were calculated by Student's t-test and were considered statistically significant at $P<0.05$.

FIG. 4C shows the standard uptake values calculated from the coronal PET images in liver (mean±s.e.m., n=3). P values were calculated by Student's t-test and were considered statistically significant at $P<0.05$.

Figure 1:
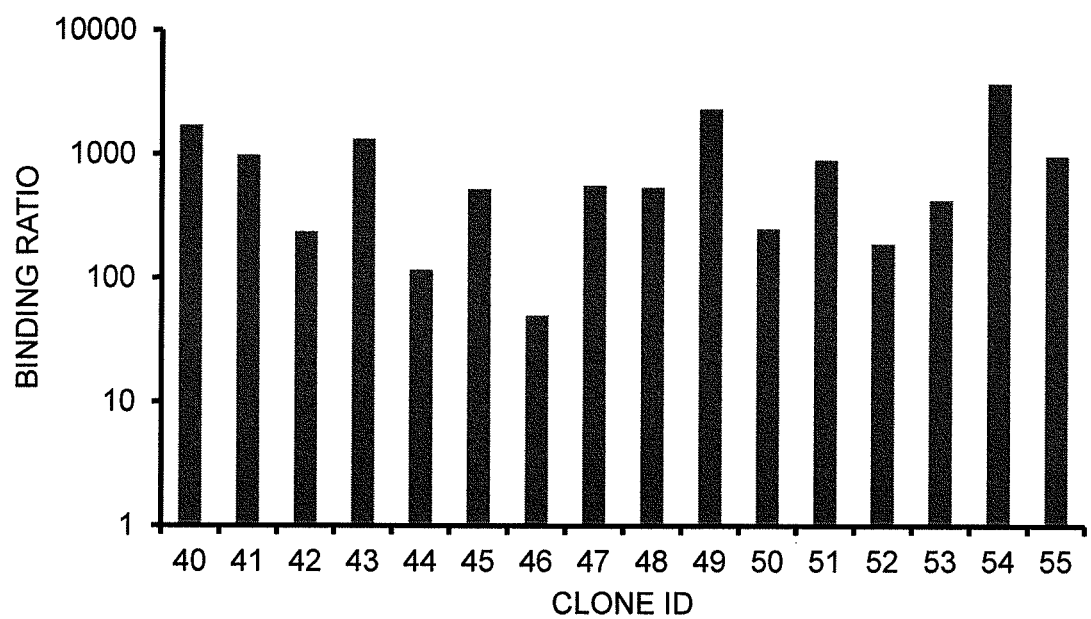
FIG. 1 shows the binding ratio of phage clones expressing peptides 40 through 55 (having the amino acid sequence set forth in SEQ ID NO: 40-55, respectively) to outgrowth endothelial cells. Binding ratio is defined as the output phage titer normalized to the titer of phage binding to a control (in this case, the plastic container which serves as the negative control).

Frequency refers to the number of times each phage was isolated out of the total number of phage sequenced.

DETAILED DESCRIPTION OF THE INVENTION

Compositions and methods are provided for targeted delivery to and detection of sites of neovascular growth, including tumor vasculature. The compositions include novel nucleotide and amino acid sequences for polypeptides that bind to blood outgrowth endothelial cells (OECs) or circulating progenitors thereof and kits comprising the same. The novel polypeptides have the amino acid sequence set forth in SEQ ID NO: 40, 41, 42, 43, 44, 45, 46, 47, 48, 49, 50, 51, 52, 53, 54, or 55, or a variant or fragment thereof that is capable of binding OECs or circulating progenitors thereof.

Further compositions include polypeptides conjugated to or complexed with a bioactive compound (e.g., drug, detectable label), wherein the polypeptide is capable of binding to OEC or a circulating progenitor thereof. Specifically, the polypeptides can have the amino acid sequence set forth in any one of SEQ ID NOs: 1-253 and variants and fragments thereof. In some embodiments, the polypeptide has the amino acid sequence set forth in any one of SEQ ID NOs: 1-55. In other embodiments, the polypeptide has the amino acid sequence set forth in any one of SEQ ID NOs: 56-168. The polypeptides find use in methods for delivering a bioactive compound to a site of neovascular growth through the administration of the polypeptides conjugated to or complexed with a bioactive compound to a subject in need thereof. The polypeptides can also be used for the detection of neovascular growth via the administration of the polypeptides conjugated to or complexed with a detectable label to a subject followed by detection of the label.

Further provided are methods for identifying additional polypeptides that can be used to target or detect neovascular growth using a functional selection process.

Neovascularization refers to the development of new blood vessels from endothelial precursor cells by any means, such as by vasculogenesis, angiogenesis, or the formation of new blood vessels from endothelial precursor cells that link to existing blood vessels. Angiogenesis is the process by which new blood vessels grow from the endothelium of existing blood vessels in a developed animal. Angiogenesis is essential for normal physiological processes, such as reproduction, and in wound healing, but it also plays a role in various disease states, including but not limited to cancer, rheumatoid arthritis, and diabetic retinopathy. In cancer, neovascularization is important for tumor growth and metastasis (Kerbel (2008) NEJM 358(19):2039-2049). Tumors form new blood vessels either from pre-existing mature ones or de novo by recruiting circulating endothelial and hematopoietic precursor cells (Rafii et al. (2002) Nature Reviews Cancer 2(11): 826-835).

Disclosed herein are methods for identifying polypeptides that bind to circulating endothelial and hematopoietic precursors that home to sites of neovascular growth. As used herein, the term "sites of neovascular growth" refers to any site within the body undergoing neovascularization. This can include, but is not limited to, tumor vasculature. Additional sites of neovascular growth include sites of cardiac angiogenic induction and sites of intimal injury.

Endothelial precursor cells such as blood outgrowth endothelial cells (BOECs), also referred to herein as outgrowth endothelial cells (OECs), circulate in the blood and selectively migrate, or "home," to sites of active angiogenesis (see U.S. Pat. No. 5,980,887, Isner et al., the contents of which are incorporated herein by reference in their entirety). OECs (also referred to as circulating bone marrow-derived endothelial cells and late EPCs) are closer to mature endothelial cells in phenotype but show surprising proliferative, migrating, and tube-forming capabilities. OECs exhibit the typical "cobblestone" morphology of endothelial cells (Lin et al. (2000) JCI 105:71-77). These cells incorporate acetylated low-density lipoprotein (LDL) (Urbich and Dimmeler (2004) Circ Res. 95:343-353) and are uniformly positive for vWF, P1H12, thrombomodulin, flk-1, VE-cadherin, PECAM-1, VEGFR2+ (a marker of endothelial cells, certain monocytes, and hematopoietic precursors), CD31 (a marker of endothelial cells and monocytes), CD34 (a marker of hematopoietic precursors and endothelial cells), CD36, and integrin $\alpha_v$. They are uniformly negative for CD14 (a marker for monocyte cells), CD133 (a marker that is present on hematopoietic precursors), and CD45 (a pan-hematopoietic marker). See, for example, Rafii et al. (2002) Gene Therapy 9:631-641; Duda et al. (2007) Nat. Protocols 2:805-810; Mallat et al. (2002) Circ Res 91:441-448; Lin et al. (2002) Blood 99:457-462; Wei et al. (2006) Gene Ther 14:344-356; Rosell (2009) J Cereb Blood Flow Metab 29:933-943; Fan et al. (2007) J Cereb Blood Flow Metab 28:90-98; Furstenberger et al. (2006) Br J Cancer 94:524-531; Chakroborty et al. (2008) The Journal of Clinical Investigation 118:1380-1389; Povsic et al. (2007) J Am Coll Cardiol 50:2243-2248; and Friedrich et al. (2006) Circ Res 98:e20-25, each of which is incorporated herein by reference in its entirety.

Methods disclosed herein allow for the identification of polypeptides that bind to OECs or circulating progenitors thereof that home to sites of neovascular growth. As used herein, "circulating progenitors" refer to endothelial and hematopoietic precursors that are found outside of the bone marrow or are capable of entering the circulation, and are capable of homing to sites of neovascular growth or active angiogenesis. Non-limiting examples of circulating progenitors that can localize to tumors include endothelial or hematopoietic precursors that express the vascular endothelial growth factor (VEGF) receptor 1 or 2 (VEGFR1 or VEGR2).

These endothelial and hematopoietic precursor cells are capable of homing to sites of cardiac angiogenic induction and localizing to sites of intimal injury to facilitate reendothelialization. These cells can restore and stimulate cardiac angiogenesis in an aging host, for example, by healing injured vascular tissues, reducing the size of atherosclerotic lesions, stimulating angiogenesis, generating cardiac myocytes, and promoting formation of new blood vessels and new endothelial tissues.

Polypeptides are provided that are capable of specifically binding to outgrowth endothelial cells (OEC) with high affinity. The novel polypeptides comprise those set forth in SEQ ID NOs: 40-55 and variants and derivatives thereof. Also provided herein are additional polypeptides that are useful in the presently disclosed methods, including for the targeting and detection of neovascular growth. Some of the peptides are characterized by the presence of consensus motifs. These consensus motifs are underlined in some of the peptides listed in Table 1.

All of the polypeptides set forth in Table 1 contain 12 amino acids. However, it is recognized that the peptides may contain fewer than 12 amino acids or more than 12 amino acids. The peptides of the invention comprise at least 6, at least 7, at least 8, at least 9 at least 10, at least 11, at least 12, up to at least about 40 amino acids. That is, the peptides may comprise at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least about 40 amino acids, at least about 50, at least about 60, at least about 70, at least about 80, at least about 100, at least about 150, at least about 200, at least about 250, at least about 300, or up to the full length of the protein which has homology with the 12-amino acid peptide listed in Table 1, including those disclosed in Table 2.

As indicated above, the peptides may contain at least one consensus motif. The motifs include PLR, PPR, TP, TPT, TPS, TPG, PPS, and MPT.

The terms "peptide" and "polypeptide", which are used interchangeably herein, broadly refer to an amino acid chain that includes naturally occurring amino acids, synthetic amino acids, genetically encoded amino acids, non-genetically encoded amino acids, and combinations thereof. Peptides can include both L-form and D-form amino acids.

Representative non-genetically encoded amino acids include but are not limited to 2-aminoadipic acid; 3-aminoadipic acid; β-aminopropionic acid; 2-aminobutyric acid; 4-aminobutyric acid (piperidinic acid); 6-aminocaproic acid; 2-aminoheptanoic acid; 2-aminoisobutyric acid; 3-aminoisobutyric acid; 2-aminopimelic acid; 2,4-diaminobutyric acid; desmosine; 2,2'-diaminopimelic acid; 2,3-diaminopropionic acid; N-ethylglycine; N-ethylasparagine; hydroxylysine; allo-hydroxylysine; 3-hydroxyproline; 4-hydroxyproline; isodesmosine; allo-isoleucine; N-methylglycine (sarcosine); N-methylisoleucine; N-methylvaline; norvaline; norleucine; and ornithine.

Representative derivatized amino acids include, for example, those molecules in which free amino groups have been derivatized to form amine hydrochlorides, p-toluene sulfonyl groups, carbobenzoxy groups, t-butyloxycarbonyl groups, chloroacetyl groups or formyl groups. Free carboxyl groups can be derivatized to form salts, methyl and ethyl esters or other types of esters or hydrazides. Free hydroxyl groups can be derivatized to form O-acyl or O-alkyl derivatives. The imidazole nitrogen of histidine can be derivatized to form N-im-benzylhistidine.

Biologically active variants of the peptides of the invention are also encompassed by the present invention. Such variants should retain binding activity to OEC, particularly the ability to specifically bind OEC or a circulating progenitor thereof that is capable of homing to sites of neovascular growth. Binding activity can be measured by methods in the art. For example, see the experimental section of the present application. Preferably, the variant has at least the same activity as the native molecule. The activity can also be associated with the affinity and/or specificity of OEC binding, or can be associated with particular downstream in vivo activities such as targeting to sites of neovascular growth, including tumor vasculature, improved perfusion, decreased neointimal formation, decreased thromboses, and greater capillary density when administered to a subject as described elsewhere herein.

Suitable biologically active variants can be fragments and derivatives. By "fragment" is intended a peptide consisting of only a part of the intact peptide sequence and structure, and can be a C-terminal deletion or N-terminal deletion of amino acids or deletions at both the C- and N-terminal ends. By "derivatives" is intended any suitable modification of a binding peptide or peptide fragment encompassing any change in amino acid residues, so long as the binding activity is retained.

Peptide variants will generally have at least 50%, at least 60%, at least 70%, preferably at least 80%, more preferably about 90% to 95% or more, about 96%, about 97%, and most preferably about 98%, about 99% or more amino acid sequence identity to the amino acid sequence of the reference peptide molecule. A variant may differ by as few as 3, 2, or even 1 amino acid residue. Methods for determining identity between sequences are well known in the art. See, for example, the ALIGN program (Dayhoff (1978) in *Atlas of Protein Sequence and Structure* 5:Suppl. 3 (National Biomedical Research Foundation, Washington, D.C.) and programs in the Wisconsin Sequence Analysis Package, Version 8 (available from Genetics Computer Group, Madison, Wis.), for example, the GAP program. For purposes of optimal alignment of the two sequences, the contiguous segment of the amino acid sequence of the variant may have additional amino acid residues or deleted amino acid residues with respect to the amino acid sequence of the reference molecule. The contiguous segment used for comparison to the reference amino acid sequence will comprise at least four (4), at least about 5, at least about 6, at least about 7, at least about 8, at least about 9, at least about 10, at least about 11, at least about 12, at least about 13, at least about 14, about 15, about 16, about 17, about 18, about 19, about 20, about 25, about 30, at least about 35 or more amino acids. Corrections for increased sequence identity associated with inclusion of gaps in the variant's amino acid sequence can be made by assigning gap penalties. Methods of sequence alignment are well known in the art. However, when calculating the percent identity of a sequence compared to an amino acid sequence consisting of any one of SEQ ID NO:1-253, the percent identity is calculated across the entirety of any one of SEQ ID NO:1-253, and gaps are typically not allowed.

When considering percentage of amino acid sequence identity, some amino acid residue positions may differ as a result of conservative amino acid substitutions, which do not affect properties of protein function. In these instances, percent sequence identity may be adjusted upwards to account for the similarity in conservatively substituted amino acids. Such adjustments are well known in the art. See, for example, Meyers and Miller (1988) *Computer Applic. Biol. Sci.* 4:11-17.

For example, preferably, conservative amino acid substitutions may be made. A "nonessential" amino acid residue is a residue that can be altered without altering the biological activity, whereas an "essential" amino acid residue is required for biological activity. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). See, for example, Sambrook J., and Russell, D. W. (2001) *Molecular Cloning: A Laboratory Manual.* (Cold Spring Harbor Laboratory Press, Cold Spring Harbor, N.Y.) and Innis, et al. (1990) *PCR Protocols: A Guide to Methods and Applications* (Academic Press, NY).

The peptides of the invention can be subject to various changes, substitutions, insertions, and deletions where such changes provide for certain advantages in its use. Thus, the term "peptide" encompasses any of a variety of forms of peptide derivatives including, for example, amides, conjugates with proteins, cyclone peptides, polymerized peptides, conservatively substituted variants, analogs, fragments, chemically modified peptides, and peptide mimetics. Any peptide that has desired binding characteristics can be used in the practice of the present invention.

By "binds specifically" or "specific binding" is intended that the peptides bind to OEC (or a circulating progenitor thereof capable of homing to sites of neovascular growth) but do not bind to other cell types. In some embodiments, a peptide that binds specifically to OEC (or a progenitor thereof capable of homing to sites of neovascular growth) binds at least 10%, 20%, 30%, 40%, 50%, 60%, 70%, 80%, 90%, 100%, 200%, 300%, 400%, 500%, or a higher percentage more than the peptide binds to an appropriate control such as, for example, a different cell type.

One aspect of the invention pertains to isolated nucleic acid molecules comprising nucleotide sequences encoding binding peptides or biologically active portions thereof. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA. The term "isolated" nucleic acid or polynucleotide is a nucleic acid molecule, DNA or RNA, that has been removed from its native environment. Examples of an isolated polynucleotide include recombinant polynucleotides maintained in heterologous host cells or purified (partially or substantially) polynucleotides in solution.

Nucleic acid molecules that are fragments of these binding peptide encoding nucleotide sequences are also encompassed by the present invention. By "fragment" is intended a portion of the nucleotide sequence encoding a binding peptide. Nucleic acid molecules that are fragments of a binding peptide nucleotide sequence comprise at least about 15, 20, 50, 75, 100 contiguous nucleotides. By "contiguous" nucleotides is intended nucleotide residues that are immediately adjacent to one another.

The skilled artisan will further appreciate that changes can be introduced by mutation into the nucleotide sequences of the invention thereby leading to changes in the amino acid sequence of the encoded binding peptides, without altering the binding specificity or affinity of the peptides. Thus, variant isolated nucleic acid molecules can be created by introducing one or more nucleotide substitutions, additions, or deletions into the corresponding nucleotide sequence disclosed herein, such that one or more amino acid substitutions, additions or deletions are introduced into the encoded peptide. Mutations can be introduced by standard techniques, such as site-directed mutagenesis and PCR-mediated mutagenesis. Such variant nucleotide sequences are also encompassed by the present invention.

Methods for the Isolation, Recruitment, and Retention of OECs

In one embodiment of the invention, the peptides disclosed herein (i.e., SEQ ID NOs: 1-253 and variants and fragments thereof) find use in methods for the isolation, recruitment, and retention of OEC. Thus, the peptides of the invention can be used to sequester OEC cells at therapeutic sites of interest and in cell-based therapeutic revascularization approaches to ischemic disease and endothelial injury. In some embodiments, the peptides that are used in such methods have the amino acid sequence set forth in any one of SEQ ID NOs: 1-55. In other embodiments, the peptides have the amino acid sequence set forth in any one of SEQ ID NOs: 56-168.

"Therapeutic sites of interest" include areas where angiogenesis is desired, areas of ischemic injury, areas of organ transplantation, areas of vascular injury, and the like. Thus, strategies can enhance the number of endothelial cells in the vessel wall following injury and limit complications such as thrombosis, vasospasm, and neointimal formation, through reconstitution of a luminal barrier and cellular secretion of paracrine factors.

The peptides of the invention can be introduced at a therapeutic site of interest. Any method for introducing the peptides at the site may be employed. In the same manner, a therapeutic site of interest can be seeded with at least one peptide of the invention to aid in the selection and retention of OEC at the site. By "seeding" or "seeded" is intended any means for introducing the peptides at the site. Such methods include injection, infusion, and the like. It is recognized that the peptides may be introduced at the site to capture and retain endogenous OEC at the site of interest. Alternatively, peptides with OEC bound may be introduced at the therapeutic site. In the same manner, the peptides may be delivered by gene delivery techniques. That is, the peptides may be expressed at a site of interest by vectors designed to express the peptides in a mammal.

The vascular diseases that can be treated by an embodiment of the present invention include vascular diseases of mammals. The word mammal means any mammal. Some examples of mammals include, for example, pet animals, such as dogs and cats; farm animals, such as pigs, cattle, sheep, and goats; laboratory animals, such as mice and rats; primates, such as monkeys, apes, and chimpanzees; and humans. In some embodiments, humans are preferably treated by the methods of the invention.

According to the invention, endothelial cells within normal vascular tissues change as they grow older, exhibit reduced angiogenesis, reduced capacity for re-endothelization and lose their ability to communicate with other cells by secreting signaling agents. These changes can lead to a diminished capacity for blood vessel formation, a reduction in blood flow to the associated organ or system, and an inability to recover from injuries or diseases that adversely affect blood vessels.

Accordingly, an embodiment of the invention relates to methods for treating endothelial dysfunction, or a vascular condition, or a circulatory condition, such as a condition associated with loss, injury or disruption of the vasculature within an anatomical site or system. The term "vascular condition" or "vascular disease" refers to a state of vascular tissue where blood flow is, or can become, impaired.

Many pathological conditions can lead to vascular diseases that are associated with alterations in the normal vascular condition of the affected tissues and/or systems. Examples of vascular conditions or vascular diseases to which the methods of the invention apply are those in which the vasculature of the affected tissue or system is senescent or otherwise altered in some way such that blood flow to the tissue or system is reduced or in danger of being reduced. Examples of vascular conditions that can be treated with the compositions and methods of the invention include atherosclerosis, preeclampsia, peripheral vascular disease, erectile dysfunction, cancers, renal failure, heart disease, and stroke. Vascular, circulatory or hypoxic conditions to which the methods of the invention apply also include those associated with, but not limited to, maternal hypoxia (e.g., placental hypoxia, preeclampsia), abnormal pregnancy, peripheral vascular disease (e.g., arteriosclerosis), transplant accelerated arteriosclerosis, deep vein thrombosis, erectile dysfunction, cancers, renal failure, stroke, heart disease, sleep apnea, hypoxia during sleep, female sexual dysfunction, fetal hypoxia, smoking, anemia, hypovolemia, vascular or circulatory conditions which increase risk of metastasis or tumor progression, hemorrhage, hypertension, diabetes, vasculopathologies, surgery (e.g., per-surgical hypoxia, post-operative hypoxia), Raynaud's disease, endothelial dysfunction, regional perfusion deficits (e.g., limb, gut, renal ischemia), myocardial infarction, stroke, thrombosis, frost bite, decubitus ulcers, asphyxiation, poisoning (e.g., carbon monoxide, heavy metal), altitude sickness, pulmonary hypertension, sudden infant death syndrome (SIDS), asthma, chronic obstructive pulmonary disease (COPD), congenital circulatory abnormalities (e.g., Tetralogy of Fallot) and Erythroblastosis (blue baby syndrome). In particular embodiments, the invention is a method of treating loss of circulation or endothelial dysfunction in an individual.

Thus, one aspect of the invention is directed to compositions useful in a method of treating diseases such as stroke, atherosclerosis, acute coronary syndromes including unstable angina, thrombosis and myocardial infarction, plaque rupture, both primary and secondary (in-stent) restenosis in coronary or peripheral arteries, transplantation-induced sclerosis, peripheral limb disease, intermittent claudication and diabetic complications (including ischemic heart disease, peripheral artery disease, congestive heart failure, retinopathy, neuropathy and nephropathy), or thrombosis.

In some embodiments, the vascular condition or vascular disease arises from damaged myocardium. As used herein "damaged myocardium" refers to myocardial cells that have been exposed to ischemic conditions. These ischemic conditions may be caused by a myocardial infarction, or other cardiovascular disease. The lack of oxygen causes death of the cells in the surrounding area, leaving an infarct that can eventually scar.

Preferably, damaged myocardium is treated with the methods and compositions of the invention before damage occurs (e.g. when damage is suspected of occurring) or as quickly as possible after damage occurs. Hence, the methods and compositions of the invention are advantageously employed on aged heart tissues that are in danger of ischemia, heart attack or loss of blood flow. The methods and compositions of the invention are also advantageously employed on recently damaged myocardium and on not so recently damaged myocardium.

As used herein "recently damaged myocardium" refers to myocardium that has been damaged within one week of treatment being started. In a preferred embodiment, treatment with the compositions of the invention is initiated within three days of myocardial damage. In a further preferred embodiment, treatment is initiated within 12 hours of myocardial damage.

In one embodiment, the present invention may be used to enhance blood vessel formation in ischemic tissue, i.e., a tissue having a deficiency in blood as the result of an ischemic disease. Such tissues can include, for example, muscle, brain, kidney and lung. Ischemic diseases include, for example, cerebrovascular ischemia, renal ischemia, pulmonary ischemia, limb ischemia, ischemic cardiomyopathy and myocardial ischemia.

The methods of the present invention may also be used to treat blood vessel injuries that result in denuding of the endothelial lining of the vessel wall. For example, primary angioplasty is becoming widely used for the treatment of acute myocardial infarction. In addition, endovascular stents are becoming widely used as an adjunct to balloon angioplasty. Stents are useful for rescuing a sub-optimal primary result as well as for diminishing restenosis. To date, however, the liability of the endovascular prosthesis has been its susceptibility to thrombotic occlusion in approximately 3% of patients with arteries 3.3 mm or larger. If patients undergo stent deployment in arteries smaller than this size, the incidence of sub-acute thrombosis is even higher. Sub-acute thrombosis is currently prevented only by the aggressive use of anticoagulation. The combination of vascular intervention and intense anticoagulation creates significant risks with regard to peripheral vascular trauma at the time of the stent/angioplasty procedure. Acceleration of re-endothelialization by administration of stents, implants, or biomedical devices coated with a peptide capable of attracting OECs to a patient undergoing, or subsequent to, angioplasty and/or stent deployment can stabilize an unstable plaque and prevent re-occlusion.

Methods for Targeted Delivery of a Bioactive Compound to Sites of Neovascular Growth The peptides of Table 1 and Table 2 (i.e., SEQ ID NOs: 1-253) and variants and fragments thereof can be used for delivering a bioactive compound to a site of neovascular growth or for detecting neovascular growth. In some embodiments, the methods include administering an effective amount of a peptide of Table 1 or Table 2 or a variant or fragment thereof that is conjugated to or otherwise complexed with a bioactive compound to a subject in need thereof. In some embodiments, the polypeptide has the amino acid sequence set forth in any one of SEQ ID NOs: 1-55. In other embodiments, the polypeptide has the amino acid sequence set forth in any one of SEQ ID NOs: 56-168.

As used herein, the term "deliver" refers to the transfer of a substance or molecule (e.g., a bioactive compound) to a physiological site, tissue, or cell. In some embodiments, the bioactive compound is selectively delivered or targeted to a particular site. The term "target" refers to the selective delivery or homing to a particular site within the body (e.g., sites of neovascular growth). In some embodiments, the bioactive compound is selectively delivered to a particular site or tissue (e.g., sites of neovascular growth) if at least 10%, 20%, 30%, 40%, 50%, 60%, 70%, 80%, 90%, 100%, 200%, 300%, 400%, 500%, or a higher percentage more of the administered bioactive compound is present in that particular site or tissue over another site or tissue.

As used herein, a "bioactive compound" is intended any agent that has a desired effect (e.g., therapeutic effect) on a living cell, tissue, or organism, or an agent that can desirably interact with a component (e.g., enzyme) of a living cell, tissue, or organism. Bioactive compounds can include, but are not limited to, polynucleotides, polypeptides, polysaccharides, organic and inorganic small molecules. The term "bioactive compound" encompasses both naturally occurring and synthetic bioactive compounds. The term "bioactive compound" can refer to a detection or diagnostic label that provides a detectable readout. The bioactive compound can be targeted to sites of neovascular growth to treat, diagnose, or monitor a disease (e.g., one associated with angiogenesis) and in some embodiments, to detect or monitor tumor growth.

Non-limiting examples of bioactive compounds that would be useful for targeting to sites of neovascular growth include chemotherapeutic drugs and angiogenic inhibitors. Chemotherapeutic agents are well known in the art (see e.g., Gilman A. G., et al., (1990) *The Pharmacological Basis of Therapeutics*, 8th Ed., Sec 12:1202-1263) and include, but are not limited to, alkylating agents, antimetabolites, natural products and their derivatives, hormones and steroids (including synthetic analogs), and synthetics. Examples of alkylating agents (e.g., nitrogen mustards, ethylenimine derivatives, alkyl sulfonates, nitrosoureas and triazenes) include uracil mustard, chlormethine, cyclophosphamide, ifosfamide, melphalan, chlorambucil, pipobroman, triethylene-melamine, triethylenethiophosphoramine, busulfan, carmustine, lomustine, streptozocin, dacarbazine, and temozolomide. Antimetabolites (including folic acid antagonists, pyrimidine analogs, purine analogs and adenosine deaminase inhibitors) may include, for example, methotrexate, 5-fluorouracil, floxuridine, cytarabine, 6-mercaptopurine, 6-thioguanine, fludarabine phosphate, pentostatine, and gemcitabine. Natural products and their derivatives (including vinca alkaloids, antitumor antibiotics, enzymes, lymphokines and epipodophyllotoxins) may also be used and include, for example, vinblastine, vincristine, vindesine, bleomycin, dactinomycin, daunorubicin, doxorubicin, epirubicin, idarubicin, paclitaxel, mithramycin, deoxyco-formycin, mitomycin-C, L-asparaginase, interferons (especially IFN-alpha), etoposide, and teniposide. Hormones and steroids (including synthetic analogs) include, for example, 17-alpha-ethinylestradiol, diethylstilbestrol, testosterone, prednisone, fluoxymesterone, dromostanolone propionate, testolactone, megestrolacetate, tamoxifen, methylprednisolone, methyltestosterone, prednisolone, triamcinolone, chlorotrianisene, hydroxyprogesterone, aminoglutethimide, estramustine, medroxyprogesteroneacetate, leuprolide, flutamide, toremifene, or zoladex. Exemplary synthetics (including inorganic complexes such as platinum coordination complexes) include cisplatin, carboplatin, hydroxyurea, amsacrine, procarbazine, mitotane, mitoxantrone, levamisole, and hexamethylmelamine.

Non-limiting examples of angiogenic inhibitors include bevacizumab, carboxyamidotriazole, suramin, thrombospondin, angiostatin, endostatin, tecogalan, thalidomide, thrombospondin, prolactin, and linomide.

In some embodiments, the neovascular growth that is targeted with the compositions of the invention is neovascular growth associated with a tumor. As used herein, "neovascular growth associated with a tumor" refers to vasculature surrounding or adjacent to a tumor that feeds the tumor, contributing to the growth of the tumor, or that allows for the metastasis of tumor cells. Therefore, subjects in need of a bioactive compound conjugated or complexed to the peptides described herein include those having a cancer.

The term "cancer" refers to the pathological condition in mammals that is typically characterized by unregulated cell growth. The term "cancer" encompasses all types of cancers, including, but not limited to, all forms of carcinomas, melanomas, sarcomas, lymphomas and leukemias. In some embodiments, the cancer that is being treated with the presently disclosed methods is one that is characterized by the formation of solid tumors. This includes without limitation, bladder cancer, brain cancer, breast cancer, cervical cancer, colorectal cancer, esophageal cancer, endometrial cancer, liver cancer, laryngeal cancer, lung cancer, osteosarcoma, ovarian cancer, pancreatic cancer, prostate cancer, renal cancer, stomach cancer, testicular cancer, thyroid cancer, and vaginal cancer. In some embodiments, the targeted site of neovascular growth comprises a lung cancer. The term "lung cancer" refers to all types of lung cancers, including but not limited to, small cell lung cancer (SCLC), non-small-cell lung cancer (NSCLC, which includes large-cell lung cancer, squamous cell lung cancer, and adenocarcinoma of the lung), and mixed small-cell/large-cell lung cancer.

In those embodiments wherein the subject that is administered the peptide-bioactive compound conjugate or complex has a cancer, the peptide targets the bioactive compound to the tumor vasculature.

In addition to cancer, numerous other non-tumorigenic angiogenesis-dependent diseases which are characterized by the abnormal growth of blood vessels may also be administered the peptide-bioactive compound conjugates or complexes of the present invention. Representative examples of such non-tumorigenic angiogenesis-dependent diseases include hypertrophic scars and keloids, proliferative diabetic retinopathy, rheumatoid arthritis, arteriovenous malformations, atherosclerotic plaques, delayed wound healing, hemophilic joints, nonunion fractures, Osler-Weber syndrome, psoriasis, pyogenic granuloma, scleroderma, tracoma, menorrhagia, vascular adhesions, hemangiomas, age-related macular degeneration, neovascular glaucoma, endometriosis, Crohn's disease, uterine fibroids, benign prostatic hyperplasia, and preeclampsia.

In some embodiments, the bioactive compound that is complexed with or conjugated to the peptide is a detectable label to allow for the detection of neovascular growth. In such methods, the peptide conjugated to or complexed with a detectable label is administered to a subject, allowing the conjugate or complex to be targeted to sites of neovascular growth, followed by detection of the detectable label to detect neovascular growth.

Detectable labels include those that can be used to follow the fate of the peptide in vitro or in vivo and include, but are not limited to, enzymes, fluorophores, chromophores, radioactive labels, chelating agents, dyes, colloidal gold, latex particles, quantum dots, ligands (e.g., biotin), chemiluminescent agents, paramagnetic isotopes and compounds, ultrasound contrast agents, and magnetic beads.

Non-limiting examples of a radioactive label include the isotopes $^{3}H$, $^{14}C$, $^{32}P$, $^{35}S$, $^{36}Cl$, $^{51}Cr$, $^{57}Co$, $^{58}Co$, $^{59}Fe$, $^{90}Y$, $^{125}I$, $^{131}I$, $^{186}Re$, gamma-emitting radionuclides, such as the radioisotope of gallium(III) and $^{123}I$, and positron-emitting radionuclides, such as carbon-11, nitrogen-13, oxygen-15, fluorine-18, or copper-64. Other examples of radioactive labels that can be used are $^{99}Tc$, $^{123}I$, $^{111}In$, $^{97}Ru$, $^{67}Cu$, $^{67}Ga$, $^{68}Ga$, $^{72}As$, $^{89}Zr$, and $^{201}Tl$. Any known currently available counting procedures may be utilized to detect radioactive labels. In those instances wherein positron-emitting radionuclides are used, positron emission tomography (PET) may be used to image the labeled peptide. In those embodiments wherein a gamma-emitting radionuclide is used as the detectable label, the labeled peptide can be detected using single photon emission computed tomography (SPECT).

Common fluorescent labels include, but are not limited to, fluorescein isothiocyanate, rhodamine, phycoerythrin, phycocyanin, allophycocyanin, o-phthaldehyde and fluorescamine. In some embodiments, a fluorescent protein, such as green fluorescent protein, red fluorescent protein, yellow fluorescent protein, or blue fluorescent protein, is used as the detectable label.

Non-limiting examples of chemiluminescers are luminol, isoluminol, theromatic acridinium ester, imidazole, acridinium salt and oxalate ester. Likewise, a bioluminescent compound may be used to label the peptide. Bioluminescence is a type of chemiluminescence found in biological systems in which a catalytic protein increases the efficiency of the chemiluminescent reaction. The presence of a bioluminescent protein is determined by detecting the presence of luminescence. Important bioluminescent compounds for purposes of labeling are luciferin, luciferase and aequorin.

In some embodiments, the detectable label is a quantum dot. Quantum dots are constructed of a semiconductor core material and are highly photostable (Gao et al. (2002) *J. Biomed. Opt.* 7:532-537). Quantum dots are known in the art and commercially available (see, for example Qdot® from Invitrogen, Carlsbad, Calif.) and can be covalently coupled to ligands using methods known in the art (see, for example, Chan and Nie (1998) *Science* 281:2016-2018, which is herein incorporated by reference). Quantum dots can be imaged using fluorescence spectroscopy.

In the instance where the label is an enzyme, detection may be accomplished by any of the presently utilized calorimetric, spectrophotometric, fluorospectrophotometric, amperometric or gasometric techniques known in the art. Suitable enzymes include, but are not limited to, alkaline phosphatase and horseradish peroxidase.

The targeting peptides may be conjugated or complexed with ultrasound contrast agents. Non-limiting examples of ultrasound contrast agents include microbubbles. The shells of microbubbles can be comprised of albumin, galactose, lipids, or polymers and the gaseous core can be a heavy gas, such as perfluorocarbon or nitrogen.

Other labels for use in the invention include magnetic beads or magnetic resonance imaging labels, such as the paramagnetic contrast agent, gadolinium. In these embodiments, the labeled peptide can be detected using magnetic resonance imaging.

Pharmaceutical Compositions

The invention encompasses pharmaceutical compositions comprising the peptides of the invention (e.g., SEQ ID NOs: 1-253). In some embodiments, the polypeptide has the amino acid sequence set forth in any one of SEQ ID NOs: 1-55. In other embodiments, the polypeptide has the amino acid sequence set forth in any one of SEQ ID NOs: 56-168. It is recognized that the pharmaceutical composition may contain a plurality of a single binding peptide or mixtures of peptides. Likewise when the peptides are used to coat implants, a single peptide may be used or a combination of peptides may be used. Pharmaceutical compositions formulated with a mixture of at least one binding peptide can be made by methods known in the art. See *Remington's Pharmaceutical Sciences* (18$^{th}$ ed.; Mack Pub. Co.: Eaton, Pa., 1990), herein incorporated by reference.

In some embodiments of the invention, the peptides of Table 1 or Table 2 (e.g., SEQ ID NOs: 1-253) or variants or fragments thereof are conjugated to or complexed with a bioactive compound. In some embodiments, the polypeptide has the amino acid sequence set forth in any one of SEQ ID NOs: 1-55. In other embodiments, the polypeptide has the amino acid sequence set forth in any one of SEQ ID NOs: 56-168. As used herein, when two compounds are "conjugated" to one another, they are linked to one another through at least one covalent bond.

The bioactive compound can also be complexed to the peptide through a non-covalent interaction that does not involve the sharing of pairs of electrons, but rather involves more dispersed variations of electromagnetic interactions, and can include hydrogen bonding, ionic interactions, Van der Waals interactions, and hydrophobic bonds. Complexes of bioactive compounds and the peptides also includes delivery vehicles, such as liposomes or lipid-derived vehicles, that comprise both the bioactive compound and the peptide. As a non-limiting example, the bioactive compound can be found inside the aqueous core of a liposome and the targeting peptide can be bound to the surface of the liposome.

Any method known in the art can be used to conjugate or complex the bioactive compound with the peptide. In some examples, an intermediary functional group might link the two compounds to one another. Non-limiting examples of intermediary functional groups include 1,4,7,10-tetraazacyclododecane-N,N',N'',N'''-tetraacetic acid (DOTA), diethylene triamine pentaacetic acid (DTPA), ethylene diamine tetraacetic acid (EDTA).

In some embodiments, the pharmaceutical composition comprises a peptide bound to the surface of a filamentous phage (e.g., M13 phage). M13 bacteriophage is a long filamentous particle approximately 6 nm in diameter and 900 nm in length. The viral genome is encapsulated in approximately 2700 copies of the major coat protein pVIII. The minor coat protein pIII that caps the particle is engineered to display five copies of a tumor-avid peptide. Five lysine groups (Lys 8, 40, 43, 44, 48) and one N-terminal amino group (Ala 1) on each pVIII subunit are available for chemical modification (Li et al. (2010) *Bioconjugate Chem* 21(7):1369-1377). Thus, in some embodiments, the peptide is fused to the pIII minor coat protein and in particular embodiments, the bioactive compound is conjugated to the major coat protein pVIII.

The pharmaceutical composition is administered to supply a desired therapeutic dose to promote a desired therapeutic response of the peptide to the therapeutic area. By "desired therapeutic response" is intended an improvement in the condition or in the symptoms associated with the condition, and the promotion of angiogenesis.

The compositions of this invention will be formulated in a unit dosage such as a solution, suspension or emulsion, in association with a pharmaceutically acceptable carrier. Such carriers are inherently nontoxic and nontherapeutic. Examples of such carriers are saline, Ringer's solution, dextrose solution, and Hanks' solution. Nonaqueous carriers such as fixed oils and ethyl oleate may also be used. The vehicle may contain minor amounts of additives such as substances that enhance chemical stability, including buffers and preservatives.

Suitable methods of delivery of the pharmaceutical composition include, but are not limited to, gel formulations, viscous solutions, sustained-release formulations, implant delivery systems, such as pumps, and the like. Such delivery systems allow for the controlled and concentrated delivery of the peptide(s) to a therapeutic site. The exact formulation employed will depend on the type of application that is desired.

A pharmaceutically effective amount of a pharmaceutical composition of the invention is administered to a subject. By "pharmaceutically effective amount" is intended an amount that is useful in the treatment of a disease or condition, where treatment can be for a therapeutic purpose as noted herein above. In this manner, a pharmaceutically effective amount of the composition will administer a therapeutically effective dose or amount of the binding peptide to the subject in need of treatment. By "therapeutically effective dose or amount" or "effective amount" is intended an amount of the binding peptide that, when administered, brings about a positive therapeutic response with respect to angiogenesis, blood vessel repair, ischemic tissue repair, and therapeutic revascularization. In other embodiments, an "effective amount" of the binding peptide is an amount that can deliver a sufficient amount of a bioactive compound in order for the bioactive compound to exert the desired effect on the site of neovascular growth or an amount of binding peptide that can deliver a sufficient amount of a detectable label to a site of neovascular growth to allow for the detection of neovascular growth. In some embodiments of the invention, the effective dose is in the range from about 0.1 µg/kg to about 100 mg/kg body weight, about 0.001 mg/kg to about 50 mg/kg, about 0.01 mg/kg to about 30 mg/kg, about 0.1 mg/kg to about 25 mg/kg, about 1 mg/kg to about 20 mg/kg, about 3 mg/kg to about 15 mg/kg, about 5 mg/kg to about 12 mg/kg, about 7 mg/kg to about 10 mg/kg or any range of value therein. It is recognized that the method of treatment may comprise a single administration of a therapeutically effective dose or multiple administrations of a therapeutically effective dose.

It is understood that the effective amount may vary depending on the nature of the effect desired, frequency of treatment, any concurrent treatment, the health, weight of the recipient, and the like. See, e.g., Berkow et al., eds., (1992) Merck Manual, 16th edition, Merck and Co., Rahway, N.J.; Goodman et al., eds., (1990) Goodman and Gilman's The Pharmacological Basis of Therapeutics, 8th edition, Pergamon Press, Inc., Elmsford, N.Y.; Avery's Drug Treatment: Principles and Practice of Clinical Pharmacology and Therapeutics, 3rd edition, ADIS Press, LTD., Williams and Wilkins, Baltimore, Md. (1987), Ebadi (1985) Pharmacology, Little, Brown and Co., Boston, Katzung (1992) Basic and Clinical Phamacology, Appleton and Lange, Norwalk, Conn., which references and references cited therein, are entirely incorporated herein by reference.

The pharmaceutical composition may be contained in a pharmaceutically-acceptable carrier. As used herein, "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Preferred examples of such carriers or diluents include, but are not limited to, water, saline, Ringer's solutions, dextrose solution, and 5% human serum albumin. The use of such media and agents for delivering cells is well known in the art. Except insofar as any conventional media or agent is incompatible with the cells or polypeptides provided herein, use thereof in the compositions is contemplated. Supplementary active compounds can also be incorporated into the compositions.

A pharmaceutical composition of the invention is formulated to be compatible with its intended route of administration. Examples of routes of administration include intravenous, intraarterial, intracoronary, parenteral, subcutaneous, subdermal, subcutaneous, intraperitoneal, intraventricular infusion, infusion catheter, balloon catheter, bolus injection, direct application to tissue surfaces during surgery, or other convenient routes. Solutions or suspensions used for such administration can include other components such as sterile diluents like water for dilution, saline solutions, polyethylene glycols, glycerin, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates, and agents for the adjustment of tonicity such as sodium chloride or dextrose. The pH can be adjusted with acids or bases, such as hydrochloric acid or sodium hydroxide. The composition can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, CREMOPHORE EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, sodium chloride in the composition. Prolonged absorption of the injectable compositions can be brought about by including in the composition an agent which delays absorption, for example, aluminum monostearate and gelatin.

Sterile injectable solutions to accompany the cellular suspensions can be prepared by incorporating an active compound (e.g., a PDGF B polypeptide or PDGF AB protein) in the required amount in an appropriate solvent with a selected combination of ingredients, followed by filter sterilization. Generally, dispersions are prepared by incorporating an active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

It is especially advantageous to formulate the cells and/or compositions in dosage unit form for ease of administration and uniformity of dosage. Dosage unit form as used herein refers to physically discrete units suited as unitary dosages for the subject to be treated. Each unit can then contain a predetermined quantity of the peptides and/or cells and other components calculated to produce the desired therapeutic effect in association with the required pharmaceutical carrier.

The pharmaceutical compositions may be co-administered with other agents known to mobilize hematopoietic precursors, with agents known to promote the differentiation of embryonic endothelial cell precursors, with chemotherapeutic agents, with anti-angiogenic agents, or with agents believed to induce angiogenesis, for example, 3-hydroxy-3-methylglutaryl coenzyme A reductase inhibitors (statins), endothelial growth factor, vascular endothelial growth factor (VEGF), fibroblast growth factor (FGF), granulocyte-colony stimulating factor (G-CSF), granulocyte-macrophage-colony stimulating factor (GM-CSF), stem cell factor (SCF), interleukin-3 (Tong et al. (1994) *Exptl. Hematol.* 22:1016-1024; de Revel et al. (1994) *Blood* 83:3795-3799; Schots et al. (1996) *Bone Marrow Transplantation* 17:509-515), and angiopoietin (Takehara et al. (1987) *Cell* 49:415-422; Suri et al. (1996) *Cell* 87:1171-1180).

Implants, Stents and Biomedical Devices

It is recognized that the peptides (e.g., SEQ ID NOs: 1-253) can be administered to therapeutic sites alone or alternatively may be attached to an acceptable implant, stent, or other biomedical device. In this manner, the implant may be coated with peptides. In some embodiments, the polypeptide has the amino acid sequence set forth in any one of SEQ ID NOs: 1-55. In other embodiments, the polypeptide has the amino acid sequence set forth in any one of SEQ ID NOs: 56-168. In some embodiments, the peptides will be attached to the implants. Likewise, when the peptides are administered directly and when they are used as coatings for implants, OEC may be attached to the peptides.

The term "implant" generally refers to a structure that is introduced into a human or animal body to restore a function of a damaged tissue or to provide a new function. An implant device can be created using any biocompatible material. Representative implants include but are not limited to: vascular prostheses, artificial heart valves, hip endoprostheses, artificial joints, jaw or facial implants, tendon and ligament replacements, skin replacements, bone replacements, bone graft devices, stents, shunts, nerve growth guides, intraocular lenses, and the like. Implants further comprise scaffolds that merely hold the peptides and/or bound OEC at therapeutic sites of interest. In general, tissue scaffolds are small, porous, implants made of specially designed biomaterials that support a therapeutic site and assist the body in growing new, functional tissue. If the scaffold is degradable, when the damaged or lost tissue has been successfully replaced by new tissue, the scaffold will have completely resorbed.

An "implantable" device is the device, which is adapted for permanent or temporary insertion into or application against a tissue of a mammal such as, for example, a human. Examples of implantable devices or components include, but are not limited to, an artificial heart, cardiac pacer leads, automatic implantable cardiodefibrilator leads, a prosthetic heart valve, a cardiopulmonary bypass membrane, a ventricular assist device, an annuloplasty ring, a dermal graft, a vascular graft, a vascular, cardiovascular, or structural stent, a catheter, a guide wire, a vascular or cardiovascular shunt, a dura mater graft, a cartilage graft, a cartilage implant, a pericardium graft, a ligament prosthesis, a tendon prosthesis, a urinary bladder prosthesis, a pledget, a suture, a permanently in-dwelling percutaneous device, an artificial joint, an artificial limb, a bionic construct (i.e. one of the aforementioned devices or components comprising a microprocessor or other electronic component), and a surgical patch.

Implants are made of a variety of materials that are known in the art and include but are not limited to: a polymer or a mixture of polymers including, for example, biodegradable plastics, polylactic acid, polyglycolic acid, polylactic acid-polyglycolic acid copolymers, polyanhidrides, polyorthoesters, polystyrene, polycarbonate, nylon, PVC, collagen (including, for example, processed collagen such as cross-linked collagen), glycosaminoglycans, hyaluronic acid, alginate, silk, fibrin, cellulose, and rubber; plastics such as polyethylene (including, for example, high-density polyethylene (HDPE)), PEEK (polyetheretherketone), and polytetrafluoroethylene; metals such as titanium, titanium alloy, stainless steel, and cobalt chromium alloy; metal oxides; non-metal oxides; silicone; bioactive glass; ceramic material such as, for example, aluminum oxide, zirconium oxide, and calcium phosphate; other suitable materials such as demineralized bone matrix; and combinations thereof. The term "polymer" as used herein refers to any of numerous natural and synthetic compounds of usually high molecular weight consisting of up to millions of repeated linked units, each a relatively simple molecule.

Synthetic grafts useful in the present invention may be composed of any material suitable for this purpose. To be suitable, a graft must be suturable to the host vessel, durable, and impervious to blood loss at implantation. Typically, synthetic grafts are pretreated prior to implantation, e.g., preclotted with autologous blood, or are coated with partially hydrolyzed proteins during manufacture. Preferred materials for the vascular grafts used in accord with the subject methods include polyethylene terephthalate and polytetrafluoroethylene (PTFE). In one embodiment, the synthetic vascular graft is composed of polyethylene terephthalate, which may be knit or woven. It is within the contemplation of this invention that these or other synthetic substances can be chemically modified to enhance their susceptibility to colonization by circulating endothelial precursor cells.

Thus, the present invention provides methods for preparing an implant to be surgically placed into a patient wherein the device is coated with at least one binding peptide. Methods for attaching peptides to implants are generally known in the art, i.e., by the use of bovine serum albumin, by the use of acrylic acid coupling, bromoalkylation, etc. The peptides may be applied by dipping, spraying, or brushing a solution containing the peptide onto the implant. See, e.g., Harris et al. (2004) *Biomaterials* 25: 4135-4148 and U.S. patent application Ser. No. 10/644,703, filed Aug. 19, 2003 and published on May 6, 2004 with Publication No. 20040087505.

In one embodiment of the invention, the peptide mediates OEC cell attachment to the surface of an implant. By enhancing OEC adhesion, the peptides of the invention can accelerate healing, accelerate angiogenesis and improve the function of the implanted device. Implants can be coated with the peptides of the invention before implantation. Likewise in some embodiments, the implants will be coated with peptides bound to OECs for implantation. This method is referred to herein as "seeding" the OECs on the implantation device.

There are multiple techniques known in the art for the seeding of selected cells to an implantation device (see, for example, U.S. Pat. Nos. 5,674,722; 5,785,965; and 5,766, 584). Typically, the implantation device is incubated in vitro, optionally with rotation, to allow the binding of the endothelial cells to the surface of the device. After several hours or days of culture, the device may be implanted into the host. Alternatively, the endothelial cells may be mixed with blood prior to application onto the implantation device.

More specifically, the number of cells deposited on the device coated with the peptides of the invention may be between about $10^3$ cells/cm$^2$ and $10^{12}$ cells/cm$^2$ of device surface, typically about $5\times10^5$ cells/cm$^2$. The cells are deposited in any convenient sterile medium, e.g. phosphate buffered saline (PBS), normal saline, M199, Dulbecco's Modified Eagles Medium (DMEM), and the like. The volume of medium will be sufficient to resuspend the cells, generally ranging from about 1 to 25 ml of medium.

After deposition, the device may be implanted immediately into the recipient or may be maintained in a conventional endothelial cell culture for a period of time. Cells employed for seeding on the implantable device may be obtained by any method known in the art. Cells may be obtained at the time of the implantation procedure using standard biopsy techniques, whether the procedure is angioplasty, open field surgery or for diagnostic purposes. The cells may also be dissociated with collagenase or trypsin and seeded directly into a matrix as exemplified below for immediate implantation or for culturing in vitro as required to generate the number of cells to be implanted. Specifically, cells may be isolated by standard methods described in, for example, Gimbrone, M. (1976) *Progress Hemostasis and Thrombosis* 3:1-28 and U.S. Pat. No. 5,131,907.

Gene Therapy

Recently, the feasibility of gene therapy for modulating angiogenesis has been demonstrated (Takeshita et al. (1996) *Laboratory Investigation* 75:487-502; Isner et al. (1996) *Lancet* 348:370; U.S. Ser. No. 08/545,998; Tsurumi et al. (1996) *Circulation* 94(12):3281-90). The peptides of the invention (e.g., SEQ ID NOs: 1-253) find use in gene therapy for modification of vascular responses including restoration of endothelial integrity, repairing of ischemic injury, promoting angiogenesis, and the like. The peptides of the invention optimize cell delivery and cell retention to the site of interest, particularly OECs at the site of vascular injury. In some embodiments, the polypeptide has the amino acid sequence set forth in any one of SEQ ID NOs: 1-55. In other embodiments, the polypeptide has the amino acid sequence set forth in any one of SEQ ID NOs: 56-168.

The peptides of the invention can be expressed from vectors and used as gene therapy vectors. Gene therapy vectors can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

In one embodiment, a host cell is genetically modified to contain a stably integrated gene that confers a therapeutic effect by methods available in the art. In one embodiment, the gene that confers a therapeutic effect is a gene that encodes one or more of the peptides of the invention. Expression of this gene in an area in need of re-endothelialization and/or vascular repair can lead to the recruitment and retention of OECs at the site of repair.

In another embodiment, the gene that confers a therapeutic effect is a gene that encodes a therapeutic peptide or protein other than the peptides of the invention. When used in combination with the peptides of the invention, vascular repair is enhanced. For example, genetically-modified OECs or other suitable endothelial precursor cells can be used to administer therapeutic agents such as angiogenic enzymes, peptides and/ or proteins with angiogenic activity, or nucleic acids or genes that encode therapeutic polypeptides involved in vascular repair. Nucleic acids encoding such therapeutic agents are introduced into OECs or endothelial precursor cells based upon their ability to optimally treat one or more vascular conditions. For example, the endothelial precursor cell can be designed to help control, diminish or otherwise facilitate improved arterial blood flow in the region of an atherosclerotic lesion.

Recombinant expression vectors are made and introduced into the cells using standard techniques, e.g., electroporation, lipid-mediated transfection, or calcium-phosphate mediated transfection, and cells containing stably integrated expression constructs are selected or otherwise identified, also using standard techniques known in the art. Methods for making recombinant DNA expression constructs, introducing them into eukaryotic cells, and identifying cells in which the expression construct is stably integrated and efficiently expressed, are described, for example, in Sambrook et al. (1989) Molecular Cloning: A Laboratory Manual, 2d Edition, Cold Spring Harbor Laboratory Press; Sambrook et al. (2001) Molecular Cloning: A Laboratory Manual, 2d Edition, Cold Spring Harbor Laboratory Press. Such methods useful for practicing the present invention are also described, for example, in U.S. Pat. No. 5,980,887.

The therapeutic agent nucleic acid sequences may be inserted into the vector by a variety of procedures. In general, DNA is inserted into an appropriate restriction endonuclease site(s) using techniques known in the art. See generally, Sambrook et al. (1989) Molecular Cloning, A Laboratory Manual, 2d ed., Cold Spring Harbor Laboratory Press, Cold Spring Harbor, N.Y.; Sambrook and Russell, Molecular Cloning: A Laboratory Manual, 3rd edition (Jan. 15, 2001) Cold Spring Harbor Laboratory Press, ISBN: 0879695765; Ausubel et al. (1989) Current Protocols in Molecular Biology, Green Publishing Associates and Wiley Interscience, NY). Construction of suitable expression vectors containing a therapeutic agent can employ standard ligation techniques that are known to the skilled artisan.

The expression cassette or vector of the invention includes a promoter. A promoter is a nucleotide sequence that controls expression of an operably linked nucleic acid sequence by providing a recognition site for RNA polymerase, and possibly other factors, required for proper transcription. A promoter includes a minimal promoter, consisting only of all basal elements needed for transcription initiation, such as a TATA-box and/or other sequences that serve to specify the site of transcription initiation. Any promoter able to direct transcription of an RNA encoding the selected therapeutic agent may be used. Accordingly, many promoters may be included within the expression cassette or vector of the invention. Some useful promoters include, constitutive promoters, inducible promoters, regulated promoters, cell specific promoters, viral promoters, and synthetic promoters. A promoter may be obtained from a variety of different sources. For example, a promoter may be derived entirely from a native gene, be composed of different elements derived from different promoters found in nature, or be composed of nucleic acid sequences that are entirely synthetic. A promoter may be derived from many different types of organisms and tailored for use within a given cell, for example, an OEC or other endothelial precursor cell.

Many mammalian promoters are known in the art that may be used in conjunction with the expression cassette of the invention. Mammalian promoters often have a transcription initiating region, which is usually placed proximal to the 5' end of the coding sequence, and a TATA box, usually located 25 30 base pairs (bp) upstream of the transcription initiation site. The TATA box is thought to direct RNA polymerase II to begin RNA synthesis at the correct site. A mammalian promoter may also contain an upstream promoter element, usually located within 100 to 200 bp upstream of the TATA box. An upstream promoter element determines the rate at which transcription is initiated and can act in either orientation (Sambrook et al. (1989) "Expression of Cloned Genes in Mammalian Cells", in: Molecular Cloning: A Laboratory Manual, 2nd ed.).

Mammalian viral genes are often highly expressed and have a broad host range; therefore sequences encoding mammalian viral genes often provide useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallothionein gene, also provide useful promoter sequences. Expression may be either constitutive or regulated.

A mammalian promoter may also be associated with an enhancer. The presence of an enhancer will usually increase transcription from an associated promoter. An enhancer is a regulatory DNA sequence that can stimulate transcription up to 1000-fold when linked to homologous or heterologous promoters, with synthesis beginning at the normal RNA start site. Enhancers are active when they are placed upstream or downstream from the transcription initiation site, in either normal or flipped orientation, or at a distance of more than 1000 nucleotides from the promoter. (Maniatis et al. (1987) *Science* 236:1237; Alberts et al. (1989) Molecular Biology of the Cell, 2nd ed.). Enhancer elements derived from viruses are often times useful, because they usually have a broad host range. Examples include the SV40 early gene enhancer (Dijkema et al. (1985) *EMBO J.* 4:761) and the enhancer/ promoters derived from the long terminal repeat (LTR) of the Rous Sarcoma Virus (Gorman et al. (1982) *Proc. Natl. Acad. Sci. USA* 79:6777) and from human cytomegalovirus (Boshart et al. (1985) *Cell* 41: 521). Additionally, some enhancers are regulatable and become active only in the presence of an inducer, such as a hormone or metal ion (Sassone-Corsi and Borelli (1986) *Trends Genet.* 2:215; Maniatis et al. (1987) *Science* 236:1237).

It is understood that many promoters and associated regulatory elements may be used within the expression cassette of the invention to transcribe an encoded protein or peptide. The promoters described above are provided merely as examples and are not to be considered as a complete list of promoters that are included within the scope of the invention.

The expression cassettes and vectors of the invention may contain a nucleic acid sequence for increasing the translation efficiency of an mRNA encoding a therapeutic agent of the invention. Such increased translation serves to increase production of the therapeutic agent. Because eukaryotic mRNA does not contain a Shine-Dalgamo sequence, the selection of the translational start codon is usually determined by its proximity to the cap at the 5' end of an mRNA. However, the nucleotides immediately surrounding the start codon in eukaryotic mRNA influence the efficiency of translation. Accordingly, one skilled in the art can determine what nucleic acid sequences will increase translation of a protein or peptide encoded by the expression cassettes and vectors of the invention.

Termination sequences can also be included in the cassettes and vectors of the invention. Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation (Birmstiel et al. (1985) *Cell* 41:349; Proudfoot and Whitelaw (1988) "Termination and 3' end processing of eukaryotic RNA", in: Transcription and Splicing (eds. B. D. Hames and D. M. Glover); Proudfoot (1989) *Trends Biochem. Sci.* 14:105). These sequences direct the transcription of an mRNA that can be translated into the polypeptide encoded by the DNA. Examples of transcription terminator/polyadenylation signals include those derived from SV40 (Sambrook et al. (1989) "Expression of cloned genes in cultured mammalian cells", in: Molecular Cloning: A Laboratory Manual).

As indicated above, nucleic acids encoding the therapeutic agents can be inserted into any convenient vector. Vectors that may be used include, but are not limited to, those that can be replicated in prokaryotes and eukaryotes. For example, vectors may be used that are replicated in bacteria, yeast, insect cells, and mammalian cells. Examples of vectors include plasmids, phagemids, bacteriophages, viruses, retroviruses, cosmids, and F-factors. However, specific vectors may be used for specific cells types. Additionally, shuttle vectors may be used for cloning and replication in more than one cell type. Such shuttle vectors are known in the art. The nucleic acid constructs or libraries may be carried extrachromosomally within a host cell or may be integrated into a host cell chromosome. Numerous examples of vectors are known in the art and are commercially available. (Sambrook and Russell, Molecular Cloning: A Laboratory Manual, 3rd edition (Jan. 15, 2001) Cold Spring Harbor Laboratory Press, ISBN: 0879695765; New England Biolab, Beverly, Mass.; Stratagene, La Jolla, Calif.; Promega, Madison, Wis.; ATCC, Rockville, Md.; CLONTECH, Palo Alto, Calif.; Invitrogen, Carlabad, Calif.; Origene, Rockville, Md.; Sigma, St. Louis, Mo.; Pharmacia, Peapack, N.J.; USB, Cleveland, Ohio). These vectors also provide many promoters and other regulatory elements that those of skill in the art may include within the nucleic acid constructs of the invention through use of known recombinant techniques.

Recombinant retroviruses can also be used which are constructed to carry or express at least one selected peptide of interest. Retrovirus vectors that can be employed include those described in EP 0 415 731; WO 90/07936; WO 94/03622; WO 93/25698; WO 93/25234; U.S. Pat. No. 5,219, 740; WO 93/11230; WO 93/10218; Vile and Hart (1993) *Cancer Res.* 53:3860-3864; Vile and Hart (1993) *Cancer Res.* 53:962-967; Ram et al. (1993) *Cancer Res.* 53:83-88; Takamiya et al. (1992) *J. Neurosci. Res.* 33:493-503; Baba et al. (1993) *J. Neurosurg.* 79:729-735; U.S. Pat. No. 4,777,127; GB Patent No. 2,200,651; WO 91/02805; and EP 0 345 242.

Packaging cell lines suitable for use with the above-described retroviral vector constructs may be readily prepared (see PCT publications WO 95/30763 and WO 92/05266), and used to create producer cell lines (also termed vector cell lines) for the production of recombinant vector particles.

It is recognized that alphavirus-based vectors can be used that can function as gene delivery vehicles. Such vectors can be constructed from a wide variety of alphaviruses, including, for example, Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532). Representative examples of such vector systems include those described in U.S. Pat. Nos. 5,091,309; 5,217,879; and 5,185,440; and PCT Publication Nos. WO 92/10578; WO 94/21792; WO 95/27069; WO 95/27044; and WO 95/07994.

Gene delivery vehicles of the present invention can also employ parvovirus such as adeno-associated virus (AAV) vectors. Representative examples include the AAV vectors disclosed by Srivastava in WO 93/09239, Samulski et al. (1989) *J. Vir.* 63:3822-3828; Mendelson et al. (1988) *Virol.* 166:154-165; and Flotte et al. (1993) *P.N.A.S.* 90:10613-10617.

Representative examples of adenoviral vectors include those described by Berkner, *Biotechniques* 6:616-627; Rosenfeld et al. (1991) *Science* 252:431-434; WO 93/19191; Kolls et al. (1994) *P.N.A.S.*:215-219; Kass-Eisler et al. (1993) *P.N.A.S.* 90:11498-11502; Guzman et al. (1993) *Circulation* 88:2838-2848; Guzman et al. (1993) *Cir. Res.* 73:1202-1207; Zabner et al. (1993) *Cell* 75:207-216; Li et al. (1993) *Hum. Gene Ther.* 4:403-409; Cailaud et al. (1993) *Eur. J. Neurosci.* 5:1287-1291; Vincent et al. (1993) *Nat. Genet.* 5:130-134; Jaffe et al. (1992) *Nat. Genet.* 1:372-378; and Levrero et al. (1992) *Gene* 101:195-202. Exemplary adenoviral gene therapy vectors employable in this invention also include those described in WO 94/12649, WO 93/03769; WO 93/19191; WO 94/28938; WO 95/11984 and WO 95/00655. Administration of DNA linked to killed adenovirus as described in Curiel (1992) *Hum. Gene Ther.* 3:147-154, may be employed.

A nucleic acid construct, or an expression vector can also be inserted into any mammalian vector that is known in the art or that is commercially available, for example, as provided by CLONTECH (Carlsbad, Calif.), Promega (Madision, Wis.), or Invitrogen (Carlsbad, Calif.). Such vectors may contain additional elements such as enhancers and introns having functional splice donor and acceptor sites. Nucleic acid constructs may be maintained extrachromosomally or may integrate in the chromosomal DNA of a host cell. Mammalian vectors include those derived from animal viruses, which require trans-acting factors to replicate. For example, vectors containing the replication systems of papovaviruses, such as SV40 (Gluzman (1981) *Cell* 23:175) or polyomaviruses, replicate to extremely high copy number in the presence of the appropriate viral T antigen. Additional examples of mammalian vectors include those derived from bovine papillomavirus and Epstein-Barr virus. Additionally, the vector may have two replication systems, thus allowing it to be maintained, for example, in mammalian cells for expression and in a prokaryotic host for cloning and amplification. Examples of such mammalian-bacteria shuttle vectors include pMT2 (Kaufman et al. (1989) *Mol. Cell. Biol.* 9:946) and pHEBO (Shimizu et al. (1986) *Mol. Cell. Biol.* 6:1074).

Methods for introduction of heterologous polynucleotides into mammalian cells are known in the art and include lipid-mediated transfection, dextran-mediated transfection, calcium phosphate precipitation, polybrene-mediated transfection, protoplast fusion, electroporation, encapsulation of -the polynucleotide(s) in liposomes, biollistics, and direct microinjection of the DNA into nuclei. The choice of method depends on the cell being transformed as certain transformation methods are more efficient with one type of cell than another. (Feigner et al. (1987) *Proc. Natl. Acad. Sci.* 84:7413; Feigner et al. (1994) *J. Biol. Chem.* 269:2550; Graham and van der Eb (1973) *Virology* 52:456; Vaheri and Pagano (1965) *Virology* 27:434; Neuman et al. (1982) *EMBO J.* 1:841; Zimmerman (1982) *Biochem. Biophys. Acta.* 694:227; Sanford et al. (1993) *Methods Enzymol.* 217:483; Kawai and Nishizawa (1984) *Mol. Cell. Biol* 4:1172; Chaney et al. (1986) *Somat. Cell Mol. Genet.* 12:237; Aubin et al. (1997) *Methods Mol. Biol.* 62:319). In addition, many commercial kits and reagents for transfection of eukaryotic cells are available.

Following transformation or transfection of a nucleic acid into a cell, the cell may be selected for the presence of the nucleic acid through use of a selectable marker. A selectable marker is generally encoded on the nucleic acid being introduced into the recipient cell. However, co-transfection of selectable marker can also be used during introduction of nucleic acid into a host cell. Selectable markers that can be expressed in the recipient host cell may include, but are not limited to, genes that render the recipient host cell resistant to drugs such as actinomycin $C_1$, actinomycin D, amphotericin, ampicillin, bleomycin, carbenicillin, chloramphenicol, geneticin, gentamycin, hygromycin B, kanamycin monosulfate, methotrexate, mitomycin C, neomycin B sulfate, novobiocin sodium salt, penicillin G sodium salt, puromycin dihydrochloride, rifampicin, streptomycin sulfate, tetracycline hydrochloride, and erythromycin. (Davies et al. (1978) *Ann. Rev. Microbiol.* 32: 469). Selectable markers may also include biosynthetic genes, such as those in the histidine, tryptophan, and leucine biosynthetic pathways. Upon transfection or transformation of a cell, the cell is placed into contact with an appropriate selection agent.

The expression cassettes may further comprise a selectable suicide gene, such as thymidine kinase (TK), which allows negative selection of grafted cells upon completion of treatment or in the event of undesired complications. TK-expressing cells can be negatively selected by the administration of gancyclovir according to methodology known in the art. Alternatively, the cassette may encode cytosine deaminase, which causes the cells to die in the presence of added 5-fluorocytosine. The expressed gene can be lethal as a toxin or lytic agent.

It is recognized that the OEC may be isolated and modified by genetic modification prior to delivery to a site of interest. See, for example, Nabel et al. (1989) *Science* 244:1342-1344; Wilson et al. (1989) *Science* 244:1344-1346; Iwaguro et al. (2002) *Circulation* 105:732-738; Jevrumovic et al. (2004) *Am J Physiol Heart Circ Physiol* 287:H494-500; all of which are herein incorporated by reference.

Methods for the Identification and Isolation of Peptides that Specifically Bind OEC or Progenitors Thereof The invention also encompasses methods for the identification and isolation of additional peptides capable of specifically binding OEC or progenitors thereof capable of homing to sites of neovascular growth. The peptides can be isolated by the methods set forth herein. The methods combine an in vitro selection process wherein a library of polypeptides are screened for polypeptides that bind OECs along with an in vivo functional screen wherein the polypeptides are further screened for the ability to bind to bone-marrow derived or mononuclear cells that home to sites of neovascular growth.

In some embodiments, a peptide library (e.g., filamentous phage peptide library) is first bound to non-OECs and the unbound peptides are carried forward. In particular embodiments, the non-OECs are human umbilical vein endothelial cells (HUVECs). The peptides that don't bind to the non-OECs are then bound to OECs. The OEC-bound peptides are separated from those that are unbound and the OEC-bound peptides are retained. In some embodiments, the binding/elution to OECs are repeated multiple times (e.g., 2, 3, 4) to enrich the peptide library for OEC-binding peptides. The enriched library is then contacted with bone marrow cells and the peptide-bound bone marrow cells are retained. The peptide-bound bone marrow cells are then administered to a subject having a tumor to allow the peptide-bound bone marrow cells to localize to the tumor. The peptides that have localized to the tumor are then isolated (e.g., via harvesting of the tumor) and the peptides that have localized to the tumor are identified. In an alternative approach, the enriched library is contacted with mononuclear cells and the peptide-bound mononuclear cells are retained. Peptide-bound bone marrow or mononuclear cells are then administered to a subject having a site of neovascular growth or a model of neovascular growth (e.g., a Matrigel plug releasing vascular endothelial growth factor (VEGF)). The peptides that have localized to the site characterized by neovascular growth are then isolated and identified.

In some embodiments, the peptide library is a filamentous phage peptide library, such as M13 phage. Phage display technology is well-known in the art and can be used to identify candidate peptides from a library of diverse peptides. Phage display describes a selection technique in which a library of variants of a peptide or protein is expressed on the outside of a phage virion, while the genetic material encoding each variant resides on the inside (Sidhu et al. (2003) *Chembiochem,* 4:14-25; Ferrer et al. (1999) *J. Pept. Res.,* 54:32-42; and, BouHamdan et al. (1998) *J. Biol. Chem.* 273:8009-8016). This creates a physical linkage between each variant protein sequence and the DNA encoding it, which allows rapid partitioning based on binding affinity to a given target molecule (antibodies, enzymes, cell-surface receptors, etc.) by an in vitro selection process called "panning" or "biopanning" (Whaley et al. (2000) *Nature* 405:665-668). Panning methods can include, for example, solution phase screening, solid phase screening, or cell-based screening.

In its simplest form, panning is carried out by incubating a library of phage-displayed peptides with a plate (or bead) coated with the target, washing away the unbound phage, and eluting the specifically bound phage. The eluted phage is then amplified and taken through additional binding/amplification cycles to enrich the pool in favor of binding sequences. After 3-4 rounds of the biopanning, the phage are bound to bone marrow cells and administered to a subject having a tumor. The phage that localize to the tumor are then recovered and individual clones are characterized by DNA sequencing and ELISA. Once a candidate peptide is identified, directed or random mutagenesis of the sequence may be used to optimize the binding properties of the peptide.

Other Laboratory Uses

In another embodiment, antibodies can be raised against the peptides of the invention (e.g., SEQ ID NOs: 1-253). In some embodiments, the polypeptide has the amino acid sequence set forth in any one of SEQ ID NOs: 1-55. These antibodies can be used to isolate or identify OECs by contacting the antibody with a population of cells that has been incubated with a sufficient amount of one or more of the OEC-binding peptides disclosed herein. The antibodies can be free in solution or bound to a solid support as discussed infra. Methods for producing antibodies are well known in the art (see, for example, Harlow and Lane (1988) "Antibodies: A Laboratory Manual," Cold Spring Harbor Laboratory, Cold Spring Harbor, N.Y.; U.S. Pat. No. 4,196,265).

OECs can be also be identified and/or purified by contacting the cells with the OEC-binding peptides of the invention. The specific and selective binding of the OECs to the peptide(s) permits the OECs to be sufficiently distinguished from contaminating cells that do not express the peptide-binding antigen. The term purified as applied to the endothelial precursor cell population utilized herein means that the population is significantly enriched in endothelial precursor cells relative to the crude population of cells from which the endothelial precursor cells are isolated. The peptides can be part of one or more reagents or kits suitable for these purposes.

When used for isolating and/or characterizing the populations of OECs, the peptides of the invention can be conjugated with labels that expedite identification and separation of the OECs from other cells in a population or sample. Examples of such labels include magnetic beads, biotin, which may be removed by avidin or streptavidin, fluorochromes, which may be used in connection with a fluorescence-activated cell sorter, and the like.

In one embodiment, the peptide is attached to a solid support. Some suitable solid supports include nitrocellulose, agarose beads, polystyrene beads, hollow fiber membranes, and plastic petri dishes. For example, the molecule can be covalently linked to Pharmacia Sepharose 6 MB macro beads. The exact conditions and duration of incubation for the solid phase-linked peptides with the crude cell mixture will depend upon several factors specific to the system employed, as is well known in the art. Cells that are bound to the peptide are removed from the cell suspension by physically separating the solid support from the cell suspension. For example, the unbound cells may be eluted or washed away with physiologic buffer after allowing sufficient time for the solid support to bind the OECs.

The bound cells are separated from the solid phase by any appropriate method, depending mainly upon the nature of the solid phase. For example, bound cells can be eluted from a plastic petri dish by vigorous agitation. Alternatively, bound cells can be eluted by enzymatically "nicking" or digesting an enzyme-sensitive "spacer" sequence between the solid phase and the peptide (or an antibody raised against the peptide as discussed supra). Suitable spacer sequences bound to agarose beads are commercially available, for example, from Pharmacia.

The eluted, enriched fraction of cells may then be washed with a buffer by centrifugation and preserved in a viable state at low temperatures for later use according to conventional technology. The cells may also be used immediately, for example by being infused intravenously into a recipient. The peptides disclosed herein (e.g., SEQ ID NOs: 1-253) may also be used to identify and/or purify OECs by means of flow cytometry, for example by means of a fluorescence-activated cell sorter (FACS), such as those manufactured by Becton-Dickinson under the names FACScan or FACSCalibur. By means of this technique, OECs are tagged with a particular fluorescent dye (i.e., "stained") by means of one or more peptides of the invention which have been conjugated to such a dye. When the stained cells are placed on the instrument, a stream of cells is directed through an argon laser beam that excites the fluorochrome to emit light. This emitted light is detected by a photo-multiplier tube (PMT) specific for the emission wavelength of the fluorochrome by virtue of a set of optical filters. The signal detected by the PMT is amplified in its own channel and displayed by a computer in a variety of different forms—e.g., a histogram, dot display, or contour display. Thus, fluorescent cells which emit at one wavelength express a molecule that is reactive with the specific fluorochrome-labeled peptide, whereas non-fluorescent cells do not express this molecule. The flow cytometer is also semi-quantitative in that it displays the amount of fluorescence (fluorescence intensity) expressed by the cell. This correlates, in a relative sense, to the number of the peptide-binding molecules expressed by the cell.

Fluorochromes which are typically used with FACS machines include fluorescein isothiocyanate (FITC), which has an emission peak at 525 nm (green), R-phycoerythrin (PE), which has an emission peak at 575 nm (orange-red), propidium iodide (PI), which has an emission peak at 620 nm (red), 7-aminoactinomycin D (7-AAD), which has an emission peak at 660 nm (red), R-phycoerythrin Cy5 (RPE-Cy5), which has an emission peak at 670 nm (red), and allophycocyanin (APC), which has an emission peak at 655-750 nm (deep red).

These and other types of FACS machines may have the additional capability to physically separate the various fractions by deflecting the cells of different properties into different containers.

In another embodiment, OECs are concentrated (or "enriched") from blood or blood products. In this manner, blood is withdrawn directly from the circulating peripheral blood of a donor and percolated continuously through a column containing the solid phase-linked binding molecule, such as an OEC-binding peptide, to capture OECs. The OEC-depleted blood is returned immediately to the donor's circulatory system by methods known in the art, such as hemapheresis. The blood is processed in this way until a sufficient number of progenitor cells binds to the column. The stem cells are then isolated from the column by methods known in the art. This method allows rare OECs to be harvested from a very large volume of blood. Transplantation of new cells into the damaged blood vessels has the potential to repair damaged vascular tissue, e.g., veins, arteries, capillaries, thereby restoring vascular function.

It is to be noted that the term "a" or "an" entity refers to one or more of that entity; for example, "a polypeptide" is understood to represent one or more polypeptides. As such, the terms "a" (or "an"), "one or more," and "at least one" can be used interchangeably herein.

Throughout this specification and the claims, the words "comprise," "comprises," and "comprising" are used in a non-exclusive sense, except where the context requires otherwise.

As used herein, the term "about," when referring to a value is meant to encompass variations of, in some embodiments ±50%, in some embodiments ±20%, in some embodiments ±10%, in some embodiments ±5%, in some embodiments ±1%, in some embodiments ±0.5%, and in some embodiments ±0.1% from the specified amount, as such variations are appropriate to perform the disclosed methods or employ the disclosed compositions.

Further, when an amount, concentration, or other value or parameter is given as either a range, preferred range, or a list of upper preferable values and lower preferable values, this is to be understood as specifically disclosing all ranges formed from any pair of any upper range limit or preferred value and any lower range limit or preferred value, regardless of whether ranges are separately disclosed. Where a range of numerical values is recited herein, unless otherwise stated, the range is intended to include the endpoints thereof, and all integers and fractions within the range. It is not intended that the scope of the presently disclosed subject matter be limited to the specific values recited when defining a range.

Unless defined otherwise, all technical and scientific terms used herein have the same meaning as commonly understood by one of skill in the art to which the invention pertains. Although any methods and materials similar herein can be used in the practice or testing of the present invention, the preferred methods and materials are described herein.

The following examples are offered by way of illustration and not by way of limitation.

EXPERIMENTAL

Example 1

Identification of Phage Clones that Bind Human Blood Outgrowth Endothelial Cells Phage display combinatorial peptide libraries are an attractive source of peptide ligands and have been widely utilized in a variety of biological, medical, and biotechnological applications (Smith and Petrenko (1997) *Chem Rev* 97(2):391-410). The phage display approach offers an important advantage in that it is highly inductive and does not require any prior knowledge of which molecular surface markers are expressed on the target, their concentration or specificity (Staquicini et al. (2010) *Proteomics Clin Appl* 4(6-7)626-632).

The strategy adopted for selection of peptide ligands that bind specifically to HBOEC involved a two-step biopanning procedure as described immediately hereinbelow. First, to decrease non-specific binding, the phage library was pre-cleared with non-HBOEC. The phage library was incubated with HUVEC and centrifuged to separate HUVEC-phage complexes and unbound phage clones. Second, the unbound phage pool was incubated with HBOEC for 1 hour at 4° C. After stringent washing, the phage that bound to HBOEC were harvested and amplified back to the original input titer of the library and used for subsequent rounds of biopanning. After three rounds of selection, individual phage were isolated and the peptide ligand sequences were determined for the randomly chosen phage clones. Peptide sequences identified using the phage display protocol that can be used in the presently disclosed methods and compositions can be found in Table 1. Peptides having SEQ ID NOs: 1-40 and 42-44 were identified in the first round of experiments, which utilized HBOEC's ranging from passage number three to eight. Peptides having SEQ ID NOs: 41 and 45-55 were identified in a second round of experiments which used first passage HBOEC's.

TABLE 1

Peptide sequences identified by phage display.

| PEPTIDE | SEQ ID NO |
|---|---|
| HPAIVHISPQWA | 1 |
| QMVYG<u>PLR</u>STEQ | 2 |
| NSLTSE<u>PLR</u>YGG | 3 |
| APFAHSGPLAFS | 4 |
| TPLHPKSLMVWH | 5 |
| SNSMHLMTMTGL | 6 |
| SV<u>PPRY</u>TLTLQW | 7 |
| TLDWTK<u>PPLR</u>SG | 8 |
| ASQGYPEHRHAS | 9 |
| HKSYLPVPSLYG | 10 |
| QTTKLHIMDTGF | 11 |
| ISPAPHLLTSRF | 12 |
| HGTNQALSLL<u>TP</u> | 13 |
| VLNPQTTVMPPL | 14 |
| ATTSL<u>TPT</u>MANH | 15 |
| QATGPT<u>TPT</u>TSG | 16 |
| <u>TPS</u>LEQRTVYAK | 17 |
| LYSASTPPDPGG | 18 |
| FPMSSYKTYA<u>TP</u> | 19 |
| INTPANRNPVLG | 20 |
| WDTNRNAAS<u>TPG</u> | 21 |
| SYQTLKQHLPYG | 22 |
| HHVDSLPTLDWK | 23 |
| KLPHQ<u>PPS</u>AAVH | 24 |
| SPWTSFLQWARG | 25 |
| QFPPKLTNNSML | 26 |
| YTDNSLGTSVGK | 27 |
| TSLRELPAEWSR | 28 |
| SHGK<u>PPS</u>FSPWT | 29 |
| YNLGQLEAQITS | 30 |
| ITLSATKGAAPS | 31 |
| SP<u>PPS</u>NAGSHHV | 32 |
| THPPNPSVSIGG | 33 |
| <u>M</u>PTSSTAPPPLI | 34 |
| ANYFSSPIKHAT | 35 |
| HPPHNMHLPAFS | 36 |
| <u>M</u>PTLTRAPHTAC | 37 |
| LPRKTPDYLQTR | 38 |
| SP<u>TPS</u>(P/L)<u>PPS</u>AGG | 39 |
| TFSKSLGPHSSL | 40 |
| SWDILKPNPQRL | 41 |

TABLE 1-continued

Peptide sequences identified by phage display.

| PEPTIDE | SEQ ID NO |
|---|---|
| SIAITTAAWSVR | 42 |
| FHTPSQNSAFRL | 43 |
| SPHYSTRVPVLL | 44 |
| QPMNTYLERRTP | 45 |
| QPMNTYLDRRTP | 46 |
| TFSNSISKTTTS | 47 |
| TFSNSITKTTTS | 48 |
| TFSNSIPKTTTS | 49 |
| TTLTHEPFSTPP | 50 |
| TVNERIIQSPTP | 51 |
| YAYTPWPPAPPT | 52 |
| ALPNPPWTSHTA | 53 |
| NFMESLPRLGMH | 54 |
| MKPDKAIRLDLL | 55 |

Potential consensus motifs are indicated with underlining. The primary consensus sequence, obtained by most commonly observed amino acid at each position, is presented in bold.

Homologies between some of the identified peptides and known protein sequences were identified and are shown in Table 2.

TABLE 2

Identified sequence homologies. Table showing potentially relevant sequence homologies identified by BLAST.

| Peptide SEQ ID NO | Peptide Sequence Homology | Protein Name (region of protein that has homology with peptide) (SEQ ID NO of region of homology) | Protein Accession No. (SEQ ID NO) |
|---|---|---|---|
| 7 | SVPPRYTLTLQW | Mucin glycoprotein (968 SIPGRYNLTLIW 979) (56) | AAQ82434 (169) |
| 10 | HKSYLPVPSLYG | Transmembrane protein 2 (41 HKSYLPV 47) (57) | CAI15172 (170) |
| 24 | KLPHQPPSAAVH | T-cell specific adaptor protein (354 LPHQPPPA 361) (58) | AAF69027 (171) |
| 17 | TPSLEQRTVYAK TPSLEQRTVYAK TPSLEQRTVYAK TPSLEQRTVYAK TPSLEQRTVYAK | Heparin sulfate proteoglycan (3152 TPAKLEQRT 3160) (59) (1894 TPTLE 1898) (60) (3929 TPSL 3932) (61) (3405 TPQLE 3409) (62) (4232 LEVRT 4236) (63) | AAA52700 (172) |
| 23 | HHVDSLPTLDWK | Interleukin-11 (70 HNLDSLPTL 78) (64) | NP_000632 (173) |
| 23 | HHVDSLPTLDWK MPTLTRAPHTAC | Ovarian cancer related tumor marker CA125 (3732 DSLSTLDW 3739) (65) (10670 PTLTKSPH 10677) (66) | AAL651133.2 (174) |
| 26 | QFPPKLTNNSML | Human immunodeficiency virus type I enhancer binding protein (233 PPKLKNSSM 241) (67) | AAI40817.1 (175) |
| 26 | QFPPKLTNNSML | Interleukin-1 receptor-associated kinase 3 isoform (304 QFQPKLTDFAM 314) (68) | NP_009130.2 (176) |
| 26 | QFPPKLTNNSML QFPPKLTNNSML QFPPKLTNNSML | Cubilin (intrinsic factor-cobalamin receptor) (3118 PPNVKSSNNSML 3129) (69) (1010 PPSLTSSGNSLML 1022) (70) (2937 PKQYDNNM 2944) (71) | EAW86221.1 (177) |
| 26 | QFPPKLTNNSML | Integrin, beta 2 (152 KLTNNS 157) (72) | EAX09383.1 (178) |
| 26 | QFPPKLTNNSML | Immunoglobulin kappa chain variable region (70 FPPKLT 75) (73) | CAC79057.1 (179) |
| 26 | QFPPKLTNNSML | Serine protease 55 isoform 2 precursor (227 PKLTKN-ML 234) (74) | NP_001183949.1 (180) |

TABLE 2 -continued

Identified sequence homologies. Table showing potentially relevant sequence homologies identified by BLAST.

| Peptide SEQ ID NO | Peptide Sequence Homology | Protein Name (region of protein that has homology with peptide) (SEQ ID NO of region of homology) | Protein Accession No. (SEQ ID NO) |
|---|---|---|---|
| 26 | QFPP<u>KLTNN</u>SML | MOP2, endothelial PAS domain protein 1 (764 KLTQNSM 770) (75) | AAC51212.1 (181) |
| 26 | QF<u>PP</u>KLTNNSML | Immunoglobulin lambda 1 light chain (44 PPKLLIFTNN 53) (76) | ABU90718.1 (182) |
| 29 | SHGK<u>PPSFSPW</u>T | FLJ00330 protein, RGD motif, leucine rich repeats (134 PPSFAPW 140) (77) | BAC03402.1 (183) |
| 29 | SHGK<u>PSFSPW</u>T<br>SHGK<u>PPSFSPW</u>T | Gag-Pro-Pol protein (987 PSFSPW 992) (78) (888 PSYSP 892) (79) | AAD51797.1 (184) |
| 29 | SHGK<u>PPSFS</u>P<u>W</u>T | Sialic acid binding Ig-like lectin 10 (175 PPSFS-WT 181) (80) | EAW72016.1 (185) |
| 29 | SHGKP<u>PSFSPWT</u> | Anti-tetanus toxoid immunoglobulin light chain variable region (93 SFSPWT 12) (81) | AAW68866.1 (186) |
| 29 | SH<u>GK</u>P<u>PPSFSPWT</u> | NRCAM protein, neuronal cell adhesion molecule (66 GKPPPSFSWT 75) (82) | AAH98401.1 (187) |
| 41 | S<u>WDIL</u>K<u>PN</u>P<u>QRL</u> | Deleted in lung and esophageal cancer 1 (648 WDIMKPNLQPL 658) (83) | NP_031363.2 (188) |
| 41 | S<u>WDILK</u>PNPQRL | T-cell activation leucine repeat-rich protein (70 WDILK 74) (84) | AAM43837.1 (189) |
| 41 | SWDILKPNPQRL | Kyphoscoliosis peptidase (324 WQLLKP-PQSL 333) (85) | EAW79132.1 (190) |
| 32 | S<u>PPPSNAGSHHV</u> | Voltage dependent calcium channel (2040 PPPSQASSHH 2049) (86) | CAI17142 (191) |
| 45<br>46 | <u>QPMN</u>TYLERRTP<br><u>QPMN</u>TYLDRRTP | ADAM5_human, ADAM metalopeptidase domain 5 (296 TYLPRRTP 303) (87) | Q6NVV9.2 (192) |
| 45 | <u>QPMN</u>TYLERRTP<br><u>QPMN</u>T<u>Y</u>LERRTP | Anoctamin-4, transmembrane protein 16D (667 QPMNAY 672) (88) (156 YLPRR 160) (89) | NP_849148.2 (193) |
| 46 | QPMNTYL<u>DRR</u>TP<br>QPMNTYLDRRTP<br><u>QPM</u>NTYLDRRTP<br>QPMNTYL<u>DR</u>RTP | Membrane Mucin MUC17 (2155 TYSDRRTP 2162) (90) (2984 ERRTP 2988) (91) (1681 PTSTYTEGRTP 1691) (92) (3602 DRSTP 3606) (93) | CAE54435.1 (194) |
| 46 | <u>QPM</u>NTYL<u>DRR</u>TP | Inteleukin-22 receptor, alpha 2 (245 QPM---LDRR 251) (94) | CAI21589.1 (195) |
| 46 | QP<u>M</u>NTYLDRRTP | HCNH6 protein, potassium voltage gated channel (10 PQNTYLD 16) (95) | AAH06334.1 (196) |
| 47 | T<u>FSNSISK</u>TTTS | Toll-like receptor 5 (246 FSNAISK 252) (96) | AAZ17473.1 (197) |
| 47 | T<u>FSNSISKTTTS</u> | Inter-alpha (globulin) inhibitor H5-like (940 TFPNTISSSTGPSSTTTS 958) (97) | EAW93188.1 (198) |
| 47 | T<u>FSNSISKTTTS</u><br>T<u>FSN</u>SISK<u>TTTS</u><br>TF<u>SNSISKTTTS</u> | Intestinal mucin 3 (116 FSSSITTTETTS 127) (98) (269 FSSSITTTET 278) (99) (83 TSSNTITETT 92) (100) | AAF13032.1 (199) |
| 47 | T<u>FSNSISK</u>TTTS<br>TF<u>SNSIS</u>KTTTS | Myosin IXa (2233 ISKTTT 2238) (101) (1215 SNRIS 1219) (102) | NP_008832.2 (200) |

TABLE 2 -continued

Identified sequence homologies. Table showing potentially relevant sequence homologies identified by BLAST.

| Peptide SEQ ID NO | Peptide Sequence Homology | Protein Name (region of protein that has homology with peptide) (SEQ ID NO of region of homology) | Protein Accession No. (SEQ ID NO) |
|---|---|---|---|
| 47 | TFSNSISKTTTS | Immunoglobulin heavy chain variable region (28 TFSNSAIS 35) (103) | ACX46937.1 (201) |
| 47 | TFSNSISKTTTS TFSNSISKTTTS | Integrin binding sialoprotein (225 SKTTTS 230) (104) (253 KTTT 256) (105) | EAX05998 (202) |
| 47 | TFSNSISKTTTS | Glycine receptor subunit alpha-4 (82 FS-SITKTT 89) (106) | NP_001165756.1 (203) |
| 48 | TFSNSITKTTTS TFSNSITKTTTS TFSNSITKTTTS | Mucin, cell surface associated (116 FSSSITTTETTS 127) (107) (269 FSSSITTTET 278) (108) (83 TSSNTITETT 92) (109) | AAC02272.1 (204) |
| 48 | TFSNSITKTTTS | G-protein coupled receptor GPCR34 (3 SHTITMTTTS 12) (110) | AAD50531 (205) |
| 48 | TFSNSITKTTTS | Anthrax toxin receptor precursor (335 TFFKSNVSITSTT 347) (111) | A6NF34.2 (206) |
| 50 | TTLTHEPFSTPP | Immunoglobulin heavy chain variable region (115 TL-EPFSAPP 123) (112) | ABI50651.1 (207) |
| 50 | TTLTHEPFSTPP | Immunoglobulin kappa light chain VLJ region (24 TTLTQSPFPS 32) (113) | BAC01711.1 (208) |
| 50 | TTLTHEPFSTPP | Anti-vaccinia virus immunoglobulin light chain variable region (4 LTHSPFS 10) (114) | ADU57768.1 (209) |
| 50 | TTLTHEPFSTPP | Calcium chanel, voltage dependent, beta 1 subunit (184 THPPSSTPP 192) (115) | EAW60560.1 (210) |
| 50 | TTLTHEPFSTPP TTLTHEPFSTPP TTLTHEPFSTPP TTLTHEPFSTPP | Mucin (160 TTPLTHVPPFST 171) (116) (329 TTLTTHVPPFST 340) (117) (93 TTITPNPTST 102) (118) (486 TTTTHPP 492) (119) | AAB61945.1 (211) |
| 50 | TTLTHEPFSTPP | L-type voltage gated channel B subunit (456 THPPSSTPP 464) (120) | AAA36169.1 (212) |
| 50 | TTLTHEPFSTPP | NALCN protein, sodium leak channel (624 LTHQALTTPP 633) (121) | AAH28390.1 (213) |
| 50 | TTLTHEPFSTPP | Mucin glycoprotein (1440 TTLPTHVPPFST 1451) (122) | AAQ82434.1 (214) |
| 51 | TVNERIIQSPTP | T-cell receptor beta variable 10 (38 ITQSPTP 44) (123) | BAF94877.1 (215) |
| 51 | TVNERIIQSPTP | Membrane protein, palmitoylated 3 (82 ER-QSPTP 88) (124) | EAW51662.1 (216) |
| 51 | TVNERIIQSPTP | JUN proto oncogene (77 ERLIIQSSNGHITTTPTP 94) (125) | CAG46552.1 (217) |
| 51 | TVNERIIQSPTP | Neurotransmitter transporter, serotonin (606 ERIIKSITP 614) (126) | ABV02581.1 (218) |
| 51 | TVNERIIQSPTP | Dystroglycan (367 TVTIRTRGAIIQTPT 381) (127) | AAA81779.1 (219) |
| 49 | TFSNSIPKTTTS | Immunoglobulin light chain variable region (53 FSDSIPGNTTT 63) (128) | AAC36644.1 (220) |

TABLE 2-continued

Identified sequence homologies. Table showing potentially relevant sequence homologies identified by BLAST.

| Peptide SEQ ID NO | Peptide Sequence Homology | Protein Name (region of protein that has homology with peptide) (SEQ ID NO of region of homology) | Protein Accession No. (SEQ ID NO) |
|---|---|---|---|
| 49 | TF<u>SNS</u>IP<u>KTTTS</u><br>TF<u>SNSIPKTTTS</u> | Mucin<br>(166 TFTSSTATSPKTTT 179) (129)<br>(263 TFSNS 267) (130) | AAB84381.1<br>(221) |
| 49 | TF<u>SNS</u>IP<u>KTTTS</u><br>TF<u>SNSIPKTTTS</u><br>TF<u>SNS</u>IPKTTTS | Gastric cancer hepatocellular carcinoma suppressor 1 variant<br>(237 SGNLPKTTTS 246) (131)<br>(200 TFTSSTATSPKTTT 213) (129)<br>(297 TFSNS 301) (130) | ACA21424.1<br>(222) |
| 49 | TF<u>SNS</u>IP<u>KT</u>TTS | B cell specific activator protein variant delta 7/8<br>(81 SIPRTTT 87) (132) | ACM91594.1<br>(223) |
| 49 | TF<u>SNS</u>IP<u>KTTTS</u><br>TF<u>SNSIPKTTTS</u><br>TF<u>SNS</u>IP<u>KTTTS</u><br>TF<u>SNS</u>IP<u>KTTTS</u><br>TF<u>SNS</u>IP<u>KTTTS</u><br>TF<u>SNS</u>IP<u>KTTTS</u><br>TF<u>SNS</u>IP<u>KTTTS</u> | G-protein coupled receptor GPR112<br>(1626 SIPKTT 1631) (133)<br>(2106 IPKPTLDSLLNIMTTTS 2122) (134)<br>(1721 KTTT 1724) (105)<br>(1354 TTTS 1357) (135)<br>(266 SISIDNTTNS 275) (136)<br>(2222 FSISI 2226) (137)<br>(1280 TSSNTVGVHIPEMSTS 1295) (138)<br>(274 NSMKKT 279) (139) | AAN46668.1<br>(224) |
| 49 | TF<u>SNS</u>IP<u>KTTTS</u> | Interleukin-1 receptor-associated kinase-2<br>(178 FSTSIPK 184) (140) | AAB87669.1<br>(225) |
| 49 | TF<u>SNS</u>IP<u>KT</u>TTS | Chorionic somatomammotropin hormone-like isoform 1 precursor (85 FSDSIP--TSS 93) (141) | NP_072101.1<br>(226) |
| 49 | TF<u>SNS</u>IP<u>KT</u>TTS | Mascarinic acetylcholine receptor M3<br>(515 TFCDSCIPKT 524) (142) | NP_000731.1<br>(227) |
| 52 | YA<u>YT</u>P<u>W</u>PPA<u>PP</u>T | Skeletal muscle sodium channel, alpha subunit<br>(1815 TAWPPAPP 1822) (143) | AAB59624.1<br>(228) |
| 52 | YA<u>YT</u>P<u>W</u>PPA<u>PP</u>T | MARCH9 protein, membrane-associated ring finger<br>(70 PWPPTPP 76) (144) | AAH50397.1<br>(229) |
| 52 | YA<u>YT</u>P<u>W</u>PPA<u>PP</u>T | Linker for activation of T-cells family member 1 isoform d<br>(95 PWPPAYPP 102) (145) | NP_001014989.2<br>(230) |
| 52 | YA<u>YT</u>P<u>W</u>PPA<u>PP</u>T | Endothelial PAS domain-containing protein 1<br>(637 TQWPPDPP 644) (146) | NP_001421.2<br>(231) |
| 53 | A<u>LPN</u>P<u>PWT</u>SH<u>T</u>A | Immunoglobulin kappa light chain variable region<br>(63 ALQTPPWT 70) (147) | AAZ09145.1<br>(232) |
| 53 | A<u>LPN</u>P<u>PWT</u>SH<u>T</u>A | Transmembrane protein 8<br>(76 LPSPPW 81) (148) | EAW85823.1<br>(233) |
| 53 | A<u>LPN</u>P<u>PWT</u>SH<u>T</u>A | Leucine-rich repeat and fibronectin type-III domain-containing protein 5 precursor<br>(628 ALP-PSWTSST 637) (149) | NP_689660.2<br>(234) |
| 53 | A<u>LPN</u>P<u>PWT</u>SH<u>T</u>A | Tumor necrosis factor receptor superfamily, member 1B<br>(183 LPKPPW 188) (150) | EAW71732.1<br>(235) |
| 53 | A<u>LPN</u>P<u>PWT</u>SH<u>T</u>A | hCG42606, isoform CRA<br>(1687 PGPPWSSPT 1695) (151) | EAW95322.1<br>(236) |
| 53 | A<u>LPN</u>P<u>PWT</u>SH<u>T</u>A | Immunoglobulin lambda light chain variable region<br>(59 PPWTS 63) (152) | AAX93773.1<br>(237) |

TABLE 2 -continued

Identified sequence homologies. Table showing potentially relevant sequence homologies identified by BLAST.

| Peptide SEQ ID NO | Peptide Sequence Homology | Protein Name (region of protein that has homology with peptide) (SEQ ID NO of region of homology) | Protein Accession No. (SEQ ID NO) |
|---|---|---|---|
| 53 | AL<u>PNPPWTSHTA</u> | Immunoglobulin kappa chain (84 PNRPPWR 90) (153) | AAA99380.1 (238) |
| 53 | ALPNP<u>PWTSHTA</u> | PDE4DIP protein, phosphodiesterase 4D interacting protein (90 PRTSHTA 96) (154) | AAI52554.1 (239) |
| 53 | AL<u>PNPPWT</u>SHTA | Transmembrane protein 119 precursor (54 LP-PPWT 59) (155) | NP_859075.2 (240) |
| 53 | ALPNP<u>PWTSHTA</u> | Seven transmembrane helix receptor (84 PWTSNT 89) (156) | BAC05878.1 (241) |
| 53 | ALPNP<u>PWTSHTA</u> | Oxoeicosanoid (OXE) receptor 1 (123 PWTSNT 128) (157) | EAX00312.1 (242) |
| 54 | N<u>FMES</u>LPRLGMH | Potassium voltage-gated channel subfamily B member 1 (675 N<u>FMEGDPSPLLPVLGM</u> 690) (158) | NP_004966.1 (243) |
| 54 | <u>NFMES</u>LPRLGMH | Erythrocyte membrane protein band 4.1 (658 NFMESVP 664) (159) | EAX07664.1 (244) |
| 54 | NFM<u>ESLPRL</u>GMH | Interleukin 17 receptor E, IL17RE (164 ESLPRL 169) (160) | AAH63110.1 (245) |
| 55 | MK<u>PDKAIRLD</u>LL | SCC-112 protein, regulator of cohesion maintenance (655 PDTAIRSGLELL 666) (161) | EAW92955.1 (246) |
| 55 | MK<u>PDKAIRLDLL</u> | Sphingomyelin phosphodiesterase 3 (468 DSAIRCGQLDLL 479) (162) | ABD83664.1 (247) |
| 55 | MK<u>PDKAIRLDLL</u> | Calcium activated potassium channel subunit beta-4 (15 DKSIRLGL 22) (163) | NP_055320.4 (248) |
| 55 | MK<u>PDKAIRLDLL</u> | WD repeat-containing protein 82 (128 <u>DKTIRLWDL</u> 136) (164) | NP_079498.2 (249) |
| 55 | MK<u>PDKAIRLDLL</u> | cGMP-gated cation channel subunit 2, hRCNC2 (599 PDK-MRLDL 606) (165) | AAB32607.1 (250) |
| 55 | MKPD<u>KAIR</u>LDLL | Carnosine dipeptidase 1 (114 KAIHLDL 120) (166) | EAW66560.1 (251) |
| 55 | <u>MKPDKAIR</u>LDLL | Effector cell protease receptor 1 (317 MKPASAIR 324) (167) | AAA19687.1 (252) |
| 55 | MK<u>PDKAI</u>RLDLL | MAM domain containing glycosylphosphatidylinositol anchor 1 (225 PDKAITFRL 233) (168) | EAX03950.1 (253) |

The underlined amino acids correspond to exact matches in peptide sequence.

Peptides having the amino acid sequence set forth in SEQ ID NO: 40, 41, 42, 43, 44, 45, 46, 47, 48, 49, 50, 51, 52, 53, 54, or 55 were determined to exhibit high binding affinity and specificity for OEC in in vitro binding assays (see FIG. 1).

Materials and Methods for Example 1
Isolation of Human Blood Outgrowth Endothelial Cells from Peripheral Blood:

The use of human material described in this study was approved by the responsible ethical committee. Fresh blood was collected from healthy volunteer donors by venipuncture and anticoagulated with buffered sodium citrate. The anticoagulated blood was diluted 1:1 with HBSS (Sigma-Aldrich) containing 1 mM EDTA and 0.5% BSA. Buffy coat mononuclear cells were obtained from diluted blood by density gradient centrifugation method using Histopaque 1077 (Sigma-Aldrich) (Lin et al. (2000) *Journal of Clinical Investigation* 105(1):71-77). The cells were washed in PBS three times at 400 g for 10 min before culturing. Buffy coat mononuclear cells from 100 ml peripheral blood were resuspended in EGM-2 medium (endothelial cell growth medium 2; Cambrex Bioscience, Walkersville, Md.) without further subpopulation enrichment procedures and placed into one well of a six well plate coated with type 1 collagen (BD Biosciences, Bedford, Mass.). The plate was incubated at 37° C. in a humidified environment with 5% $CO_2$. Non adherent cells were removed after 48 hours and every second day thereafter. Colonies with cobblestone morphology appeared after 3-4 weeks in culture. These cells were cultured until they formed larger colonies. Colonies were selected, trypsinized, and expanded over several passages by using standard cell culture procedures. Cells ranging from passage three to eight were used in a first set of experiments, whereas cells from the first passage were used in a second set of experiments.

Human Umbilical Vein Endothelial Cells (HUVEC):

HUVEC were from the American Type Culture Collection (ATCC, Manassas, Va.). Passages 4 to 8 were used in this study. HUVEC were cultured in EGM-MV medium (Cambrex) at 37° C. in an incubator with humid atmosphere and 5% $CO_2$.

Biopanning Procedure:

Cells at 80% confluence were detached by treating with 0.05% trypsin-EDTA, washed once with EGM-2 medium and resuspended in EGM-2 containing 1% BSA at $1.10^5$ cells per ml. In the pre-clearing step, 1 ml of HUVEC suspension at $1.10^5$ cells per ml were incubated with 10 µl of PhD-12 peptide phage display system (New England Biolabs, Beverly, Mass.) within 1.5 ml Eppendorf tube for 2 hours at 4° C.; the mixture was then centrifuged. In the screening step, the unbound phage pool remaining in the supernatant was transferred to a fresh tube and incubated with 1 ml of HBOEC at $1.10^5$ cells per ml. After 1 hour incubation at 4° C., the cell-phage complexes were separated by centrifugation. Following five intensive washes with TBS-0.5% Tween-20 buffer the bound phage was non-specifically eluted with 0.2 M Glycine-HCl buffer (pH 2.2) for 10 min. The eluate was immediately neutralized by 1M Tris.HCl buffer (pH 9.0). An aliquot of the eluted phage was used for determining titer by plaque assay. The rest of the phage eluate was amplified in mid-log phase *E. coli* ER2738 (New England Biolabs), and purified by precipitation with polyethylene glycol. An aliquot of the amplified phage was subsequently re-applied to newly trypsinized cells for a total of three biopanning rounds and two amplification steps.

DNA Sequencing

After three rounds of biopanning, *E. Coli* ER2738 were infected with the recovered phage and then plated onto LB agar plates. Single phage colonies were picked and amplified in LB medium. DNA was purified and sequenced by using a primer hybridizing to −96 position of the insert following the manufactures instructions. DNA sequencing was performed by the UNC-CH Genome Analysis Facility (Chapel Hill, N.C.).

Homogeneous Phage Recovery

Once isolated individual phage clones were subjected to evaluation of relative binding. High titer stocks of homogeneous phage were generated. Serially diluted phage ($1.10^9$ pfu, $1.10^{10}$ pfu, and $1.10^{11}$ pfu) were incubated with HBOEC ($1.10^5$ cells) for 1 h at 4° C. and then subjected to the same wash protocol used for the selection experiments. In parallel, the same procedure was carried out in a blocked Eppendorf tube without HBOEC to rule out non-specific binding for each selected sequence to the plastic container, used here as a negative control. Binding ratio is defined as recovery of phage bound to the target cells normalized to the recovery of phage non-specifically bound to the plastic.

Example 2

Figure 2:
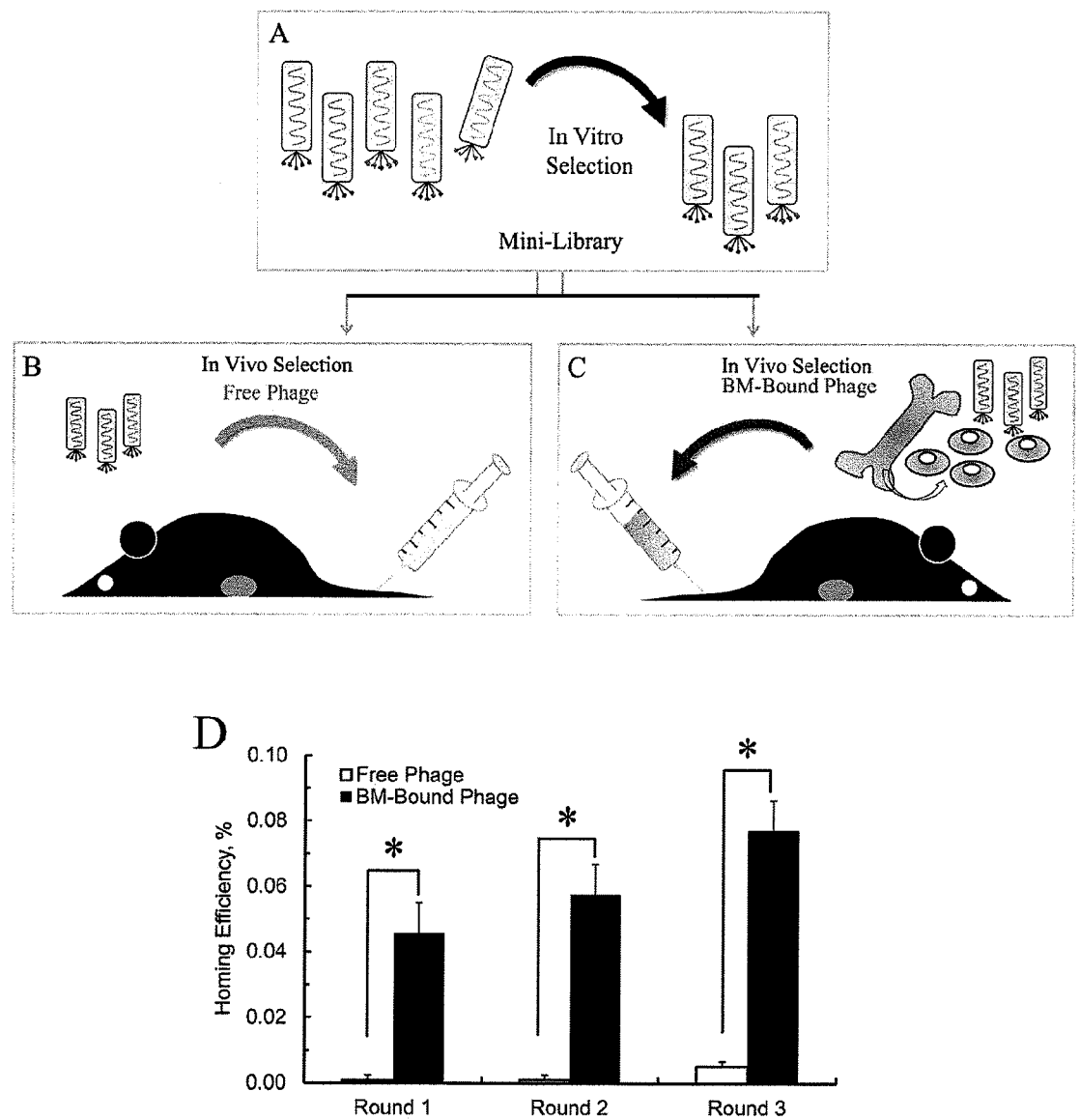
FIGS. 2A-2D show the selection of tumor-associated phage via a combination of in vitro and in vivo biopanning protocols.

Functional Selection and In Vivo Characterization of a Tumor-Associated Peptide from a Phage Display Library During development, hematopoietic and vascular endothelial progenitors originate from a common precursor cell, the hemangioblast, and share several phenotypic characteristics (Wang et al. (2007) *J Biol Chem* 282(1):782-791). This shared phenotype was exploited by using human blood outgrowth endothelial cells (HBOEC) cultured from peripheral blood mononuclear cells to enrich a phage library before panning on BM cells. This allows for the discovery of peptides that specifically recognize molecular markers expressed both by endothelial precursors and distinct BM sub-population(s). To distinguish the cell population(s) of BM origin capable of homing to tumors, a functional feature was introduced into the screen: only phage carried by BM cells to angiogenic tumors were propagated and used for subsequent enrichment. FIGS. 2A-2C depict a schematic of the selection procedures. After one round of negative selection on human umbilical vein endothelial cells (HUVEC) to deplete the library of clones that bind to common cell surface receptors and three rounds of positive selection on HBOEC in vitro, a mini-library of enriched phage pool were generated for further downstream biopanning (FIG. 2A). Two distinct in vivo selection protocols were utilized in parallel and the results were compared: (i) The mini-library was either directly injected intravenously into a mouse bearing subcutaneously implanted LLC tumor (FIG. 2B) or (ii) A functional step was employed that consisted of administering BM-bound phage into a mouse bearing a subcutaneously implanted LLC tumor (FIG. 2C). To enable the latter protocol, murine BM cells from femoral and tibial bones were isolated and the cell suspension was labeled with the mini-library. Free phage or BM-bound phage were allowed to circulate for 2 hours. Then the mice were perfused through the heart with PBS and the tumors were harvested. Tumor-associated phage pools from each protocol was propagated separately in *E. Coli*, and used in subsequent enrichment cycles. The efficiency of each cycle was quantified as the ratio of the output phage titer to input phage titer multiplied by 100. As seen from FIG. 2D, using BM cells to deliver phage to tumors improves the efficiency of the selection procedure dramatically.

Figure 3:
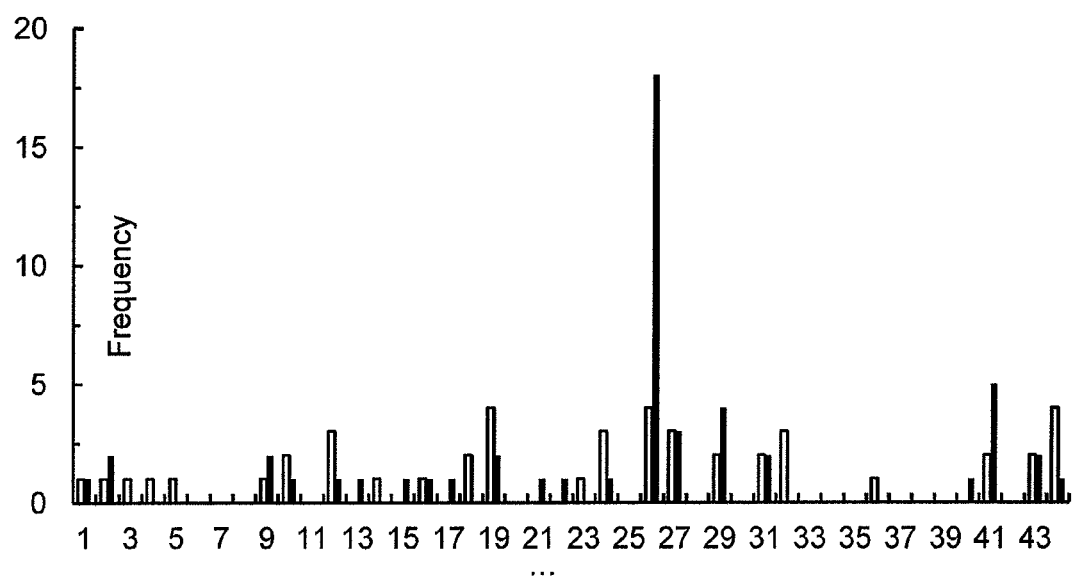
FIG. 3 shows the frequency of sequenced peptide ligands selected either by panning with free phage (open bars) or by panning using bone marrow-bound phage (closed bars). After three rounds of in vivo selection, fifty phage clones from each protocol were randomly chosen for sequencing. Frequency refers to the number of times each phage was isolated out of the total number of phage sequenced. In vivo selection with free phage produces no apparent enrichment of particular clones. By stark contrast, three rounds of in vivo functional selection, using BM cells to direct the phage pool to the tumor site, are sufficient to identify a dominant amino acid sequence.

After three rounds of in vivo selection, fifty randomly chosen phage clones resulting from each protocol were plaque purified and sequenced. FIG. 3 presents the phage inserts sequencing distribution profiles for both selection procedures. The biopanning protocol with free phage does not produce a noticeable enrichment after three rounds of in vivo selection. In contrast to what is seen with free phage, when BM cells are utilized in the panning procedure a dominant phage clone emerges. The sequencing results in FIG. 3 are in agreement with the homing efficiency findings in FIGS. 2D, supporting the observation that the selection procedure based on specific functional attributes has remarkable efficiency and produces a phage clone that displays a preferentially enriched amino acid sequence.

The dominant phage expresses the QFPPKLTNNSML (SEQ ID NO: 26) peptide. This phage clone was selected for further in vivo tumor targeting studies and was designated QFP-phage. The distribution of QFP-phage and a control insertless phage was examined after intravenous injection into mice bearing subcutaneously implanted LLC tumors by determining the amount of infectious phage particles in tumor and tissue extracts. QFP-phage when bound to BM cells homed to LLC tumors to the same extent as the selected phage pool (data not shown). Moreover, control phage carrying no peptide did not localize to the tumor site. The QFP-phage also accumulated in the liver but not in heart, brain and muscle tissue (data not shown).

Next, the ability of the QFPPKLTNNSML (SEQ ID NO: 26) peptide to deliver molecular cargo to sites of ongoing angiogenesis was explored by noninvasive positron emission tomography (PET) imaging. For this purpose, a labeling platform employing the phage that displays the QFPPKLTNNSML (SEQ ID NO: 26) peptide as a molecularly targeted imaging agent was developed. Using phage as imaging probes and biological nanoparticles in targeting tumors offers an immediate advantage: phage can be covalently attached to numerous labels while simultaneously expressing multiple copies of the tumor-avid peptide (Deutscher (2010) *Chem Rev* 110(5):3196-3211).

M13 bacteriophage is a long filamentous particle approximately 6 nm in diameter and 900 nm in length. The viral genome is encapsulated in approximately 2700 copies of the major coat protein pVIII. The minor coat protein pIII that caps the particle is engineered to display five copies of a tumor-avid peptide. Five lysine groups (Lys 8, 40, 43, 44, 48) and one N-terminal amino group (Ala 1) on each pVIII subunit are available for chemical modification (Li et al. (2010) *Bioconjugate Chem* 21(7):1369-1377). In this study QFP-phage were labeled with $^{64}$Cu radionuclide via the macrocyclic chelator 1,4,7,10-tetraazacyclododecane-1,4,7,10-tetra acetic acid (DOTA). First, the phage particle was functionalized by conducting a coupling chemical reaction between amino groups exposed on the phage surface and the bifunctional p-SCN-Bn-DOTA derivative.

In a second step, a labeling reaction was performed to attach the $^{64}$Cu$^{2+}$ radiometal to the DOTA-phage-QFP construct. $^{64}$Cu radiolabeled insertless phage conjugates and $^{64}$Cu-DOTA complexes were prepared to serve as controls. The chemical modification of the phage surface did not affect cellular binding or phage infectivity (results not shown). Thus, phage retained target affinity and biological activity on labeling.

PET imaging was utilized to quantitate noninvasively the ability of the $^{64}$Cu labeled QFP-phage to bind in vivo to its target in angiogenic highly vascularized subcutaneously implanted LLC tumors (n=3). The labeled phage were injected i.v. into a tumor bearing mouse and the localization of $^{64}$Cu-DOTA-phage-QFP radiotracer visualized. The distribution of two control radiotracers, $^{64}$Cu-DOTA and $^{64}$Cu-DOTA-phage with no peptide insert, was examined in parallel. Representative decay corrected coronal PET images at 18 hours post-injection are shown in FIG. 4A. $^{64}$Cu-DOTA-phage-QFP was able to bind its target in vivo thus producing an excellent tumor uptake and contrast in the tumor tissue while the control phage showed little to no accumulation in the tumor. $^{64}$Cu-DOTA complex revealed a completely different pattern of in vivo distribution confirming that the signal from the $^{64}$Cu-DOTA-phage-QFP is due to the $^{64}$Cu-DOTA covalently bound in a stable manner to the QFP-phage vector. FIGS. 4B and 4C quantify the standard uptake values (SUV) for the tumor and liver, respectively. $^{64}$Cu-DOTA-phage-QFP has a statistically higher standard tumor uptake value compared to both controls.

Figure 4:
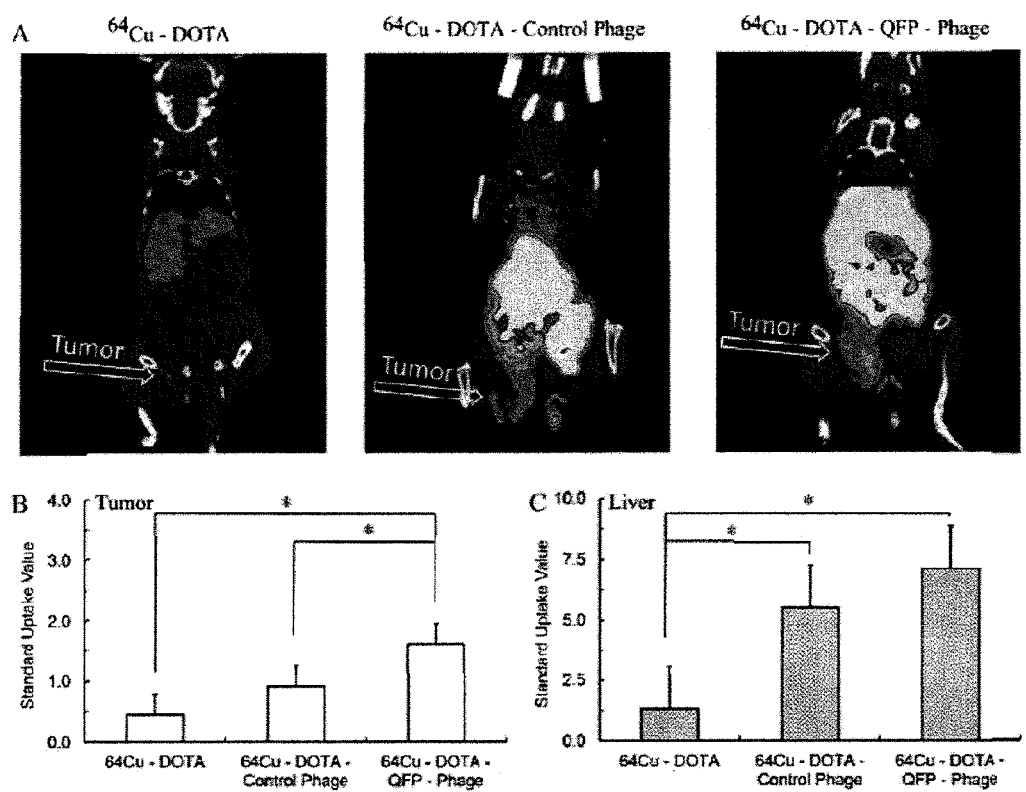
FIGS. 4A-4C show the visualization of in vivo peptide binding by positron emission tomography (PET).

As seen in FIG. 4, there is a capture of radiolabeled phage by the liver. These observations are consistent with the findings from the phage distribution experiments discussed above. Both QFP-phage and the insertless control phage are taken up and catabolized by the liver. The fact that liver localization is independent of the presence of a peptide on the surface of the phage clearly indicates that liver uptake is a property of the phage, and not the peptide carried by the phage. Taken together, the imaging results reveal that the QFPPKLTNNSML (SEQ ID NO: 26) peptide identified by in vivo functional selection from a phage display peptide library can deliver molecular cargo to angiogenic tumors.

Materials and Methods for Example 2
Animals
Female C57BL/6 mice (Jackson Laboratories, Bar Harbor, Me.) 6 to 8 weeks old were used in this study. The animal experiments were approved by the Institutional Animal Care and Use Committee at the University of North Carolina at Chapel Hill.

Cell Culture
Human blood outgrowth endothelial cells (HBOEC) were isolated from peripheral blood of consented volunteer donors and cultured as previously described (Veleva et al. (2007) *Biotech and Bioeng* 98(1):306-312; Veleva et al. (2008) *Biomaterials* 29(27):3656-3661). Human umbilical vein endothelial cells (HUVEC) (Lonza, Walkersville, Md.) were maintained in EGM-2 Bullet Kit medium (Lonza). Murine Lewis lung carcinoma (LLC) cells (ATCC, Manassas, Va.) were grown in Dulbecco's modified Eagles medium (DMEM) supplemented with 10% fetal bovine serum. Murine bone marrow cells were collected by flushing femoral and tibial bones of black mice with 1 ml cold PBS containing 1 mM EDTA and 0.5% BSA. BM cells were used without further subpopulation enrichment procedures.

Tumors
To establish tumors, mice were anesthetized by intraperitoneal administration of Avertin (0.02 ml/g). LLC cells were trypsinized, washed three times in DMEM, counted and re-suspended in 500 µl growth factor reduced Matrigel basement membrane matrix (BD Biosciences, Bedford, Mass.). Approximately 5×10$^6$ LLC cells were implanted subcutaneously in the inguinal region of each mouse.

Phage Library Screening
Combinatorial peptide library displayed on the N-terminus of the pIII minor coat protein of bacteriophage M13 was purchased from New England Biolabs (Beverly, Mass.). The library contains approximately 2.7×10$^9$ random 12-mer amino acid sequences. Tumor-associated peptide ligands were selected by a combination of in vitro and in vivo panning protocols. Briefly, for the in vitro selection, 1×10$^{11}$ pfu of the original library were pre-cleared on HUVEC suspension for 2 h at 4° C. The phage supernatant from the negative selection on HUVEC was incubated for 1 h at 4° C. with HBOEC suspension. Unbound phage pool was washed way, HBOEC-bound phage were eluted, amplified in *E. Coli*, and used for subsequent enrichment cycles as previously described (Veleva et al. (2007) *Biotech and Bioeng* 98(1):306-312). After three rounds of biopanning on HBOEC, the enriched phage pool, designated as mini-library, was utilized for in vivo selection. Two selection schemes were designed and the experiments were conducted in parallel: (i) The mini-library (1×10$^{11}$ pfu) was injected i.v. into the tail vein of a LLC tumor bearing mouse or (ii) The mini-library (1×10$^{11}$ pfu) was used for labeling freshly isolated BM cells. Phage were allowed to bind to the BM cell suspension in EGM-2 containing 0.5% BSA for 1 h at RT. Unbound phage were washed way and BM-bound phage were administered i.v. in a LLC tumor bearing mouse. In both schemes, 2 hours post-phage injection the mice were perfused through the heart with PBS, the tumors harvested, and processed to elute the tumor-bound phage. Phage from each protocol were amplified separately in *E. Coli*, and either were administered i.v. in a LLC tumor bearing mouse, or bound to BM cells and used for the next round of functional selection. The phage panning process was repeated three times for free phage and for BM-bound phage, respectively. All biopanning experiments were carried out 4 days post-tumor implantation. This time point was determined experimentally by monitoring the ability of subcutaneously implanted LLC tumors to recruit BM cells (data not shown).

For each in vivo screening procedure, fifty individual phage clones were randomly picked and the peptide coding inserts were sequenced using -96III sequencing primer, 5'-GCCCTCATAGCGTAACG-3' (SEQ ID NO: 254), (New England Biolabs) following manufactures instructions.

The selectivity of individual clones towards LLC tumors and phage distribution in major tissues were analyzed using the same protocols and conditions as for the mini-library screening.

Phage Modification

QFP-phage and control insertless phage were amplified to a high titer for labeling with $^{64}$Cu radionuclide via the macrocyclic bifunctional chelator 2-(4-isothiocyanato benzyl)-1, 4,7,10 tetraazacyclo dodecane-1,4,7,10-tetraacetic acid (p-SCN-Bn-DOTA) (Macrocyclics, Dallas, Tex.). The isothiocyanate functionality of the p-SCN-Bn-DOTA reacts with primary amino groups on the phage coat protein pVIII to produce a covalent attachment of DOTA to the phage surface (Jakubowski et al. (2008) *J Anal At Spectrom* 23(5):1497-1507). To carry out this functionalization procedure, phage ($1\times10^{11}$ pfu) were re-suspended in 400 μl conjugation buffer (carbonate-bicarbonate buffer, pH=9) and 4 μl p-SCN-Bn-DOTA (100 mM stock) were added. The conjugation reaction was conducted overnight at 35° C. DOTA-phage intermediate was separated from the unreacted DOTA through a 50K microcone filter by centrifugation at 14000 g for 10 minutes. DOTA-phage conjugates were re-suspended in 400 μl 10.1M sodium acetate buffer (pH=5.5) and incubated with $^{64}$CuCl$_2$ (2 mCi per reaction, decay corrected) for 50 minutes at 50° C. Unbound $^{64}$Cu$^{2+}$ was removed by ultracentrifugation as described above. $^{64}$Cu labeled phage were reconstituted in sterile PBS. Activity was determined using a γ-counter (Packard) immediately before injecting into mice. Complexes of DOTA-phage with cold CuCl$_2$ were prepared to test phage infectivity and target binding upon labeling.

MicroPET Imaging

MicroPET scans and image analysis were performed on a GE Explore Vista microPET/CT rodent scanner. At seven days post-implantation, mice bearing subcutaneous LLC tumors (tumor volume approx. 1 cm$^3$) were injected with 800 μCi of radiotracer ($^{64}$Cu-DOTA (n=3), $^{64}$Cu-DOTA-control phage (n=2) or $^{64}$Cu-DOTA-QFP-phage (n=3) into the tail vein at a volume 150 μl. Ten minute microPET static scans were acquired 18 hours post-contrast injection under isoflurane anesthesia. Images were reconstructed and the radioactivity concentration within tumor and liver was converted into standard uptake values. Regions of interest (ROI) for the tumor were selected from the right lateral (actively perfused shell of the tumor), avoiding the (necrotic/lower intensity) regions. Location of the ROI within tumor margins was confirmed by comparison with the registered CT image. The liver ROI was selected in the uniform central region of the right lobe, placed away from the edges to avoid partial volume effect from the large voxel size in PET images.

Example 3

In Vivo Functional Selection of Phage that Home to Sites Characterized by Neovascular Growth The same mini-library that was generated in Example 2 by a negative selection step on human umbilical vein endothelial cells (HUVEC) and three rounds of positive selection on HBOEC underwent one of three in vivo functional selection steps in mice: (i) phage bound to the mononuclear fraction of human peripheral blood were injected intravenously into a mouse (NOD/SCID) bearing a subcutaneously implanted Matrigel plug releasing human vascular endothelial growth factor (hVEGF); or (ii) the mini-library was either directly injected intravenously into a mouse (C57B16) bearing a subcutaneously implanted Matrigel plug releasing murine vascular endothelial growth factor (mVEGF); or (iii) phage bound to bone marrow cells were injected intravenously into a mouse (C57B16) bearing a subcutaneously implanted Matrigel plug releasing mVEGF. The VEGF-releasing Matrigel plug was used as a model of a site characterized by neovascular growth.

The mononuclear fraction of human peripheral blood was isolated using the method described in Veleva et al. (2007) *Biotechnology and Bioengineering* 98:306-312. The mononuclear fraction was labeled with the mini-library as described in Example 2. The BM-bound phage were prepared as described in Example 2 and the free phage or cell-bound phage were injected into the mice as described in Example 2. Two hours post-phage injection, the mice were perfused through the heart with PBS, the Matrigel plug harvested, and processed to elute the bound phage. Phage from each protocol were amplified separately in *E. coli*, and were either bound to mononuclear cells, bone marrow cells, or left unbound, and used in subsequent enrichment cycles.

Figure 5:
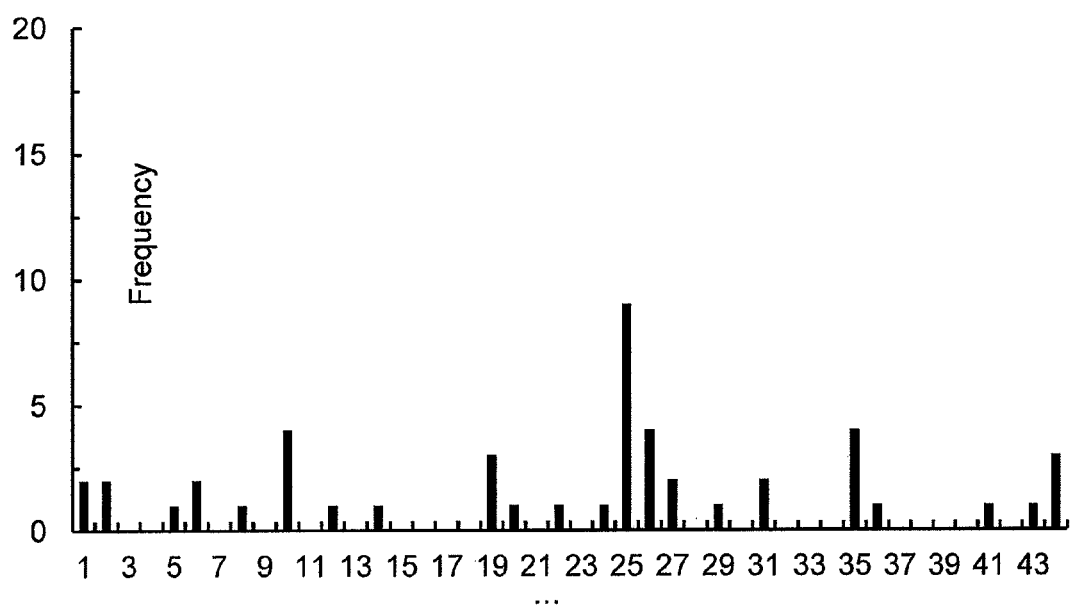
FIG. 5 shows the frequency of sequenced peptide ligands selected by panning with phage bound to circulating cells from the mononuclear fraction isolated from human peripheral blood utilizing Matrigel plugs releasing human vascular endothelial growth factor (hVEGF) as a model of neovascular growth. After three rounds of in vivo selection, fifty phage clones were randomly chosen for sequencing. Frequency refers to the number of times each phage was isolated out of the total number of phage sequenced.
Figure 6:
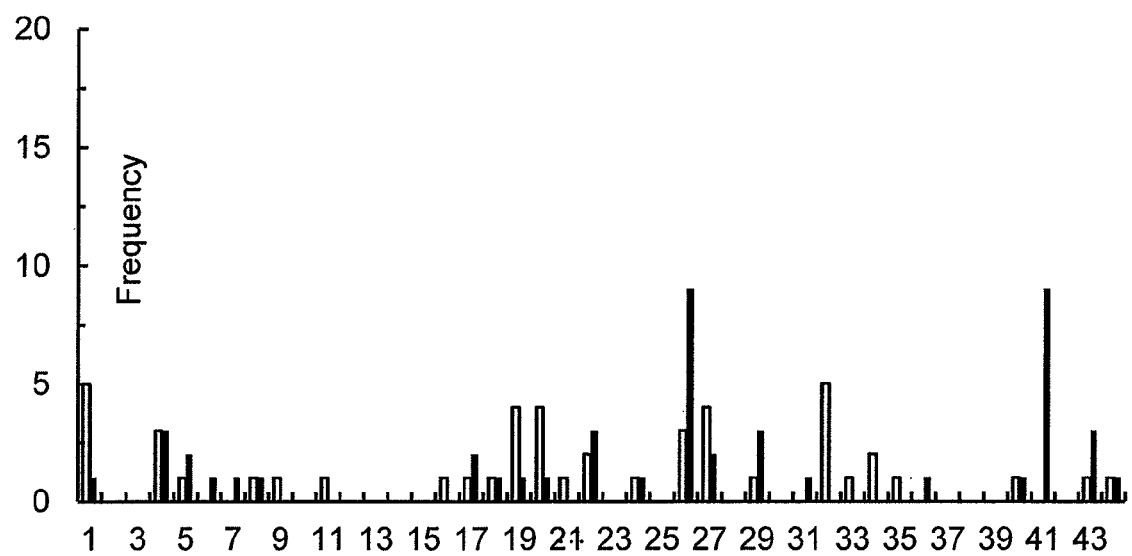
FIG. 6 shows the frequency of sequenced peptide ligands selected either by panning with free phage (open bars) or by panning using bone marrow-bound phage (closed bars) utilizing Matrigel plugs releasing mouse vascular endothelial growth factor (mVEGF) as a model of neovascular growth. After three rounds of in vivo selection, fifty phage clones from each protocol were randomly chosen for sequencing.

After three rounds of in vivo selection, fifty randomly chosen phage clones resulting from each protocol were plaque purified and sequenced. FIG. 5 presents the phage inserts sequencing distribution profiles for the selection procedure utilizing mononuclear cell-bound phage. The peptide having the amino acid sequence set forth in SEQ ID NO: 25 was the most frequently identified phage that homed to the hVEGF-releasing Matrigel plug when bound to mononuclear cells. FIG. 6 presents the phage inserts sequencing distribution profiles for the selection procedure wherein free phage or BM-bound phage were administered to mice bearing a Matrigel plug releasing mVEGF. When BM cells were utilized in the panning procedure, dominant phage clones emerge (e.g., SEQ ID NOs: 26 and 41).

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the foregoing list of embodiments and appended claims. Although specific terms are employed herein, they are used in a generic and descriptive sense only and not for purposes of limitation.

SEQUENCE LISTING (254 sequences)

SEQ ID NO: 1 - protein, 12 aa, Artificial Sequence
  Human outgrowth endothelial cell-binding peptides isolated from phage library
HPAIVHISPQWA

SEQ ID NO: 2 - protein, 12 aa, Artificial Sequence
  Human outgrowth endothelial cell-binding peptides isolated from phage library
QMVYGPLRSTEQ

SEQ ID NO: 3 - protein, 12 aa, Artificial Sequence
  Human outgrowth endothelial cell-binding peptides isolated from phage library
NSLTSEPLRYGG

SEQ ID NO: 4 - protein, 12 aa, Artificial Sequence
  Human outgrowth endothelial cell-binding peptides isolated from phage library
APFAHSGPLAFS

SEQ ID NO: 5 - protein, 12 aa, Artificial Sequence
  Human outgrowth endothelial cell-binding peptides isolated from phage library
TPLHPKSLMVWH

SEQ ID NO: 6 - protein, 12 aa, Artificial Sequence
  Human outgrowth endothelial cell-binding peptides isolated from phage library
SNSMHLMTMTGL

SEQ ID NO: 7 - protein, 12 aa, Artificial Sequence
  Human outgrowth endothelial cell-binding peptides isolated from phage library
SVPPRYTLTLQW

SEQ ID NO: 8 - protein, 12 aa, Artificial Sequence
  Human outgrowth endothelial cell-binding peptides isolated from phage library
TLDWTKPPLRSG

SEQ ID NO: 9 - protein, 12 aa, Artificial Sequence
  Human outgrowth endothelial cell-binding peptides isolated from phage library
ASQGYPEHRHAS

SEQ ID NO: 10 - protein, 12 aa, Artificial Sequence
  Human outgrowth endothelial cell-binding peptides isolated from phage library
HKSYLPVPSLYG

SEQ ID NO: 11 - protein, 12 aa, Artificial Sequence
  Human outgrowth endothelial cell-binding peptides isolated from phage library
QTTKLHIMDTGF

SEQ ID NO: 12 - protein, 12 aa, Artificial Sequence
  Human outgrowth endothelial cell-binding peptides isolated from phage library
ISPAPHLLTSRF

SEQ ID NO: 13 - protein, 12 aa, Artificial Sequence
  Human outgrowth endothelial cell-binding peptides isolated from phage library
HGTNQALSLLTP

SEQ ID NO: 14 - protein, 12 aa, Artificial Sequence
  Human outgrowth endothelial cell-binding peptides isolated from phage library
VLNPQTTVMPPL

SEQ ID NO: 15 - protein, 12 aa, Artificial Sequence
  Human outgrowth endothelial cell-binding peptides isolated from phage library
ATTSLTPTMANH

SEQ ID NO: 16 - protein, 12 aa, Artificial Sequence
  Human outgrowth endothelial cell-binding peptides isolated from phage library
QATGPTTPTTSG

SEQ ID NO: 17 - protein, 12 aa, Artificial Sequence
  Human outgrowth endothelial cell-binding peptides isolated from phage library
TPSLEQRTVYAK

SEQ ID NO: 18 - protein, 12 aa, Artificial Sequence
  Human outgrowth endothelial cell-binding peptides isolated from phage library
LYSASTPPDPGG

SEQ ID NO: 19 - protein, 12 aa, Artificial Sequence
  Human outgrowth endothelial cell-binding peptides isolated from phage library
FPMSSYKTYATP

SEQ ID NO: 20 - protein, 12 aa, Artificial Sequence
  Human outgrowth endothelial cell-binding peptides isolated from phage library
INTPANRNPVLG

SEQ ID NO: 21 - protein, 12 aa, Artificial Sequence
  Human outgrowth endothelial cell-binding peptides isolated from phage library
WDTNRNAASTPG

SEQ ID NO: 22 - protein, 12 aa, Artificial Sequence
  Human outgrowth endothelial cell-binding peptides isolated from phage library
SYQTLKQHLPYG

SEQ ID NO: 23 - protein, 12 aa, Artificial Sequence
  Human outgrowth endothelial cell-binding peptides isolated from phage library
HHVDSLPTLDWK

SEQ ID NO: 24 - protein, 12 aa, Artificial Sequence
  Human outgrowth endothelial cell-binding peptides isolated from phage library
KLPHQPPSAAVH

SEQ ID NO: 25 - protein, 12 aa, Artificial Sequence
  Human outgrowth endothelial cell-binding peptides isolated from phage library
SPWTSFLQWARG

SEQ ID NO: 26 - protein, 12 aa, Artificial Sequence
  Human outgrowth endothelial cell-binding peptides isolated from phage library
QFPPKLTNNSML

SEQ ID NO: 27 - protein, 12 aa, Artificial Sequence
  Human outgrowth endothelial cell-binding peptides isolated from phage library
YTDNSLGTSVGK

SEQ ID NO: 28 - protein, 12 aa, Artificial Sequence
  Human outgrowth endothelial cell-binding peptides isolated from phage library
TSLRELPAEWSR

SEQ ID NO: 29 - protein, 12 aa, Artificial Sequence
  Human outgrowth endothelial cell-binding peptides isolated from phage library
SHGKPPSFSPWT

SEQ ID NO: 30 - protein, 12 aa, Artificial Sequence
  Human outgrowth endothelial cell-binding peptides isolated from phage library
YNLGQLEAQITS

SEQ ID NO: 31 - protein, 12 aa, Artificial Sequence
  Human outgrowth endothelial cell-binding peptides isolated from phage library
ITLSATKGAAPS

SEQ ID NO: 32 - protein, 12 aa, Artificial Sequence
  Human outgrowth endothelial cell-binding peptides isolated from phage library
SPPPSNAGSHHV

SEQ ID NO: 33 - protein, 12 aa, Artificial Sequence
  Human outgrowth endothelial cell-binding peptides isolated from phage library
THPPNPSVSIGG

SEQ ID NO: 34 - protein, 12 aa, Artificial Sequence
  Human outgrowth endothelial cell-binding peptides isolated from phage library
MPTSSTAPPPLI

SEQ ID NO: 35 - protein, 12 aa, Artificial Sequence
  Human outgrowth endothelial cell-binding peptides isolated from phage library
ANYFSSPIKHAT

SEQ ID NO: 36 - protein, 12 aa, Artificial Sequence
  Human outgrowth endothelial cell-binding peptides isolated from phage library
HPPHNMHLPAFS

SEQ ID NO: 37 - protein, 12 aa, Artificial Sequence
  Human outgrowth endothelial cell-binding peptides isolated from phage library
MPTLTRAPHTAC

SEQ ID NO: 38 - protein, 12 aa, Artificial Sequence
  Human outgrowth endothelial cell-binding peptides isolated from phage library
LPRKTPDYLQTR

SEQ ID NO: 39 - protein, 12 aa, Artificial Sequence
  Consensus sequence for Human outgrowth endothelial cell-binding peptides isolated from phage library
  VARIANT 6: Xaa = Pro or Leu
SPTPSXPPSAGG

SEQ ID NO: 40 - protein, 12 aa, Artificial Sequence
  Human outgrowth endothelial cell-binding peptides isolated from phage library
TFSKSLGPHSSL

SEQ ID NO: 41 - protein, 12 aa, Artificial Sequence
  Human outgrowth endothelial cell-binding peptides isolated from phage library
SWDILKPNPQRL

SEQ ID NO: 42 - protein, 12 aa, Artificial Sequence
  Human outgrowth endothelial cell-binding peptides isolated from phage library
SIAITTAAWSVR

SEQ ID NO: 43 - protein, 12 aa, Artificial Sequence
  Human outgrowth endothelial cell-binding peptides isolated from phage library
FHTPSQNSAFRL

SEQ ID NO: 44 - protein, 12 aa, Artificial Sequence
  Human outgrowth endothelial cell-binding peptides isolated from phage library
SPHYSTRVPVLL

SEQ ID NO: 45 - protein, 12 aa, Artificial Sequence
  Human outgrowth endothelial cell-binding peptides isolated from phage library
QPMNTYLERRTP

SEQ ID NO: 46 - protein, 12 aa, Artificial Sequence
  Human outgrowth endothelial cell-binding peptides isolated from phage library
QPMNTYLDRRTP

SEQ ID NO: 47 - protein, 12 aa, Artificial Sequence
  Human outgrowth endothelial cell-binding peptides isolated from phage library
TFSNSISKTTTS

SEQ ID NO: 48 - protein, 12 aa, Artificial Sequence
  Human outgrowth endothelial cell-binding peptides isolated from phage library
TFSNSITKTTTS

SEQ ID NO: 49 - protein, 12 aa, Artificial Sequence
  Human outgrowth endothelial cell-binding peptides isolated from phage library
TFSNSIPKTTTS

SEQ ID NO: 50 - protein, 12 aa, Artificial Sequence
  Human outgrowth endothelial cell-binding peptides isolated from phage library
TTLTHEPFSTPP

SEQ ID NO: 51 - protein, 12 aa, Artificial Sequence
  Human outgrowth endothelial cell-binding peptides isolated from phage library
TVNERIIQSPTP

SEQ ID NO: 52 - protein, 12 aa, Artificial Sequence
  Human outgrowth endothelial cell-binding peptides isolated from phage library
YAYTPWPPAPPT

SEQ ID NO: 53 - protein, 12 aa, Artificial Sequence
  Human outgrowth endothelial cell-binding peptides isolated from phage library
ALPNPPWTSHTA

SEQ ID NO: 54 - protein, 12 aa, Artificial Sequence
  Human outgrowth endothelial cell-binding peptides isolated from phage library
NFMESLPRLGMH

SEQ ID NO: 55 - protein, 12 aa, Artificial Sequence
  Human outgrowth endothelial cell-binding peptides isolated from phage library
MKPDKAIRLDLL

SEQ ID NO: 56 - protein, 12 aa, Homo sapiens
SIPGRYNLTLIW

SEQ ID NO: 57 - protein, 7 aa, Homo sapiens
HKSYLPV

SEQ ID NO: 58 - protein, 8 aa, Homo sapiens
LPHQPPPA

SEQ ID NO: 59 - protein, 9 aa, Homo sapiens
TPAKLEQRT

SEQ ID NO: 60 - protein, 5 aa, Homo sapiens
TPTLE

SEQ ID NO: 61 - protein, 4 aa, Homo sapiens
TPSL

SEQ ID NO: 62 - protein, 5 aa, Homo sapiens
TPQLE

SEQ ID NO: 63 - protein, 5 aa, Homo sapiens
LEVRT

SEQ ID NO: 64 - protein, 9 aa, Homo sapiens
HNLDSLPTL

SEQ ID NO: 65 - protein, 8 aa, Homo sapiens
DSLSTLDW

SEQ ID NO: 66 - protein, 8 aa, Homo sapiens
PTLTKSPH

SEQ ID NO: 67 - protein, 9 aa, Homo sapiens
PPKLKNSSM

SEQ ID NO: 68 - protein, 11 aa, Homo sapiens
QFQPKLTDFAM

SEQ ID NO: 69 - protein, 12 aa, Homo sapiens
PPNVKSSNNSML

SEQ ID NO: 70 - protein, 13 aa, Homo sapiens
PPSLTSSGNSLML

SEQ ID NO: 71 - protein, 8 aa, Homo sapiens
PKQYDNNM

SEQ ID NO: 72 - protein, 6 aa, Homo sapiens
KLTNNS

SEQ ID NO: 73 - protein, 6 aa, Homo sapiens
FPPKLT

SEQ ID NO: 74 - protein, 8 aa, Homo sapiens
PKLTKNML

SEQ ID NO: 75 - protein, 7 aa, Homo sapiens
KLTQNSM

SEQ ID NO: 76 - protein, 10 aa, Homo sapiens
PPKLLIFTNN

SEQ ID NO: 77 - protein, 7 aa, Homo sapiens
PPSFAPW

SEQ ID NO: 78 - protein, 6 aa, Homo sapiens
PSFSPW

SEQ ID NO: 79 - protein, 5 aa, Homo sapiens
PSYSP

SEQ ID NO: 80 - protein, 7 aa, Homo sapiens
PPSFSWT

SEQ ID NO: 81 - protein, 6 aa, Homo sapiens
SFSPWT

SEQ ID NO: 82 - protein, 10 aa, Homo sapiens
GKPPPSFSWT

SEQ ID NO: 83 - protein, 11 aa, Homo sapiens
WDIMKPNLQPL

SEQ ID NO: 84 - protein, 5 aa, Homo sapiens
WDILK

SEQ ID NO: 85 - protein, 10 aa, Homo sapiens
WQLLKPPQSL

SEQ ID NO: 86 - protein, 10 aa, Homo sapiens
PPPSQASSHH

SEQ ID NO: 87 - protein, 8 aa, Homo sapiens
TYLPRRTP

SEQ ID NO: 88 - protein, 6 aa, Homo sapiens
QPMNAY

SEQ ID NO: 89 - protein, 5 aa, Homo sapiens
YLPRR

SEQ ID NO: 90 - protein, 8 aa, Homo sapiens
TYSDRRTP

SEQ ID NO: 91 - protein, 5 aa, Homo sapiens
ERRTP

SEQ ID NO: 92 - protein, 11 aa, Homo sapiens
PTSTYTEGRTP

SEQ ID NO: 93 - protein, 5 aa, Homo sapiens
DRSTP

SEQ ID NO: 94 - protein, 7 aa, Homo sapiens
QPMLDRR

SEQ ID NO: 95 - protein, 7 aa, Homo sapiens
PQNTYLD

SEQ ID NO: 96 - protein, 7 aa, Homo sapiens
FSNAISK

SEQ ID NO: 97 - protein, 19 aa, Homo sapiens
TFPNTISSSTGPSSTTTTS

SEQ ID NO: 98 - protein, 12 aa, Homo sapiens
FSSSITTTETTS

SEQ ID NO: 99 - protein, 10 aa, Homo sapiens
FSSSITTTET

SEQ ID NO: 100 - protein, 10 aa, Homo sapiens
TSSNTITETT

SEQ ID NO: 101 - protein, 6 aa, Homo sapiens
ISKTTT

SEQ ID NO: 102 - protein, 5 aa, Homo sapiens
SNRIS

SEQ ID NO: 103 - protein, 8 aa, Homo sapiens
TFSNSAIS

SEQ ID NO: 104 - protein, 6 aa, Homo sapiens
SKTTTS

SEQ ID NO: 105 - protein, 4 aa, Homo sapiens
KTTT

SEQ ID NO: 106 - protein, 8 aa, Homo sapiens
FSSITKTT

SEQ ID NO: 107 - protein, 12 aa, Homo sapiens
FSSSITTTETTS

SEQ ID NO: 108 - protein, 10 aa, Homo sapiens
FSSSITTTET

SEQ ID NO: 109 - protein, 10 aa, Homo sapiens
TSSNTITETT

SEQ ID NO: 110 - protein, 10 aa, Homo sapiens
SHTITMTTTS

SEQ ID NO: 111 - protein, 13 aa, Homo sapiens
TFFKSNVSITSTT

SEQ ID NO: 112 - protein, 9 aa, Homo sapiens
TLEPFSAPP

SEQ ID NO: 113 - protein, 10 aa, Homo sapiens
TTLTQSPFPS

SEQ ID NO: 114 - protein, 7 aa, Homo sapiens
LTHSPFS

SEQ ID NO: 115 - protein, 9 aa, Homo sapiens
THPPSSTPP

SEQ ID NO: 116 - protein, 12 aa, Homo sapiens
TTPLTHVPPFST

SEQ ID NO: 117 - protein, 12 aa, Homo sapiens
TTLTTHVPPFST

SEQ ID NO: 118 - protein, 10 aa, Homo sapiens
TTITPNPTST

SEQ ID NO: 119 - protein, 7 aa, Homo sapiens
TTTTHPP

SEQ ID NO: 120 - protein, 9 aa, Homo sapiens
THPPSSTPP

SEQ ID NO: 121 - protein, 10 aa, Homo sapiens
LTHQALTTPP

SEQ ID NO: 122 - protein, 12 aa, Homo sapiens
TTLPTHVPPFST

SEQ ID NO: 123 - protein, 7 aa, Homo sapiens
ITQSPTP

SEQ ID NO: 124 - protein, 7 aa, Homo sapiens
ERQSPTP

SEQ ID NO: 125 - protein, 18 aa, Homo sapiens
ERLIIQSSNGHITTTPTP

SEQ ID NO: 126 - protein, 9 aa, Homo sapiens
ERIIKSITP

SEQ ID NO: 127 - protein, 15 aa, Homo sapiens
TVTIRTRGAIIQTPT

SEQ ID NO: 128 - protein, 11 aa, Homo sapiens
FSDSIPGNTTT

SEQ ID NO: 129 - protein, 14 aa, Homo sapiens
TFTSSTATSPKTTT

SEQ ID NO: 130 - protein, 5 aa, Homo sapiens
TFSNS

SEQ ID NO: 131 - protein, 10 aa, Homo sapiens
SGNLPKTTTS

SEQ ID NO: 132 - protein, 7 aa, Homo sapiens
SIPRTTT

SEQ ID NO: 133 - protein, 6 aa, Homo sapiens
SIPKTT

SEQ ID NO: 134 - protein, 17 aa, Homo sapiens
IPKPTLDSLLNIMTTTS

SEQ ID NO: 135 - protein, 4 aa, Homo sapiens
TTTS

SEQ ID NO: 136 - protein, 10 aa, Homo sapiens
SISIDNTTNS

SEQ ID NO: 137 - protein, 5 aa, Homo sapiens
FSISI

SEQ ID NO: 138 - protein, 16 aa, Homo sapiens
TSSNTVGVHIPEMSTS

SEQ ID NO: 139 - protein, 6 aa, Homo sapiens
NSMKKT

SEQ ID NO: 140 - protein, 7 aa, Homo sapiens
FSTSIPK

SEQ ID NO: 141 - protein, 9 aa, Homo sapiens
FSDSIPTSS

SEQ ID NO: 142 - protein, 10 aa, Homo sapiens
TFCDSCIPKT

SEQ ID NO: 143 - protein, 8 aa, Homo sapiens
TAWPPAPP

SEQ ID NO: 144 - protein, 7 aa, Homo sapiens
PWPPTPP

SEQ ID NO: 145 - protein, 8 aa, Homo sapiens
PWPPAYPP

SEQ ID NO: 146 - protein, 8 aa, Homo sapiens
TQWPPDPP

SEQ ID NO: 147 - protein, 8 aa, Homo sapiens
ALQTPPWT

SEQ ID NO: 148 - protein, 6 aa, Homo sapiens
LPSPPW

SEQ ID NO: 149 - protein, 10 aa, Homo sapiens
ALPPSWTSST

SEQ ID NO: 150 - protein, 6 aa, Homo sapiens
LPKPPW

SEQ ID NO: 151 - protein, 9 aa, Homo sapiens
PGPPWSSPT

SEQ ID NO: 152 - protein, 5 aa, Homo sapiens
PPWTS

SEQ ID NO: 153 - protein, 7 aa, Homo sapiens
PNRPPWR

SEQ ID NO: 154 - protein, 7 aa, Homo sapiens
PRTSHTA

SEQ ID NO: 155 - protein, 4 aa, Homo sapiens
PPWT

SEQ ID NO: 156 - protein, 6 aa, Homo sapiens
PWTSNT

SEQ ID NO: 157 - protein, 6 aa, Homo sapiens
PWTSNT

SEQ ID NO: 158 - protein, 16 aa, Homo sapiens
NFMEGDPSPLLPVLGM

SEQ ID NO: 159 - protein, 7 aa, Homo sapiens
NFMESVP

SEQ ID NO: 160 - protein, 6 aa, Homo sapiens
ESLPRL

SEQ ID NO: 161 - protein, 12 aa, Homo sapiens
PDTAIRSGLELL

SEQ ID NO: 162 - protein, 12 aa, Homo sapiens
DSAIRCGQLDLL

SEQ ID NO: 163 - protein, 8 aa, Homo sapiens
DKSIRLGL

SEQ ID NO: 164 - protein, 9 aa, Homo sapiens
DKTIRLWDL

SEQ ID NO: 165 - protein, 8 aa, Homo sapiens
PDKMRLDL

SEQ ID NO: 166 - protein, 7 aa, Homo sapiens
KAIHLDL

SEQ ID NO: 167 - protein, 8 aa, Homo sapiens
MKPASAIR

SEQ ID NO: 168 - protein, 9 aa, Homo sapiens
PDKAITFRL

SEQ ID NO: 169 - protein, 1569 aa, Homo sapiens
MVQRWLLLSCCGALLSAGLANTSYTSPGLQRLKDSPQTAPDKGQCSTWGAGHFSTFDHHVYDFSGTCNYIFAATCKDAFPSFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARGCTQLLTLVAPECSVSKEPFVLSCQADVAAAPQPGPQNSSYATLSEYSRQCSMVGQPVALRSPGLCSVGQCPANQVYQECGSACVKTCSNSEHSCSSSCTFGCFCPEGTDLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPDALERETDPCSMSQLNKVCAETHCSMLLRTGTVFERCHATVNPAPIYKRCMYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRLQMFLASCQAPKTFKSCSQSSENKFGAACAPTCQMLATGVACVPTKCEPGCVCAEGLYENAYGQCVPPEECPCEFSGVSYPGGAELHTDCRTCSCSRGRWACQQGTHCPSTCTLYGEGHVITFDGQRFVFDGNCEYILATDVCGVNYSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMASSASNHSAPTGTIPPPTTLKATGSTHTAPPITPTTSGTSQAHSSFSTNKTPTSLHSHTSSTHHPEVTPTSTTSITPNPTSTRTRTPMAHTNSATSSRPP

SEQ ID NO: 170 - protein, 217 aa, Homo sapiens
MAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 171 - protein, 389 aa, Homo sapiens [sequence omitted]

SEQ ID NO: 172 - protein, 4391 aa, Homo sapiens [sequence omitted]

SEQ ID NO: 173 - protein, 199 aa, Homo sapiens
MNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 174 - protein, 22152 aa, Homo sapiens
  VARIANT 13877, 13878, 13880, 13887, 13890, 13891, 13893, 13903, 13913,13914, 13916, 13928, 13929, 13938, 13940, 13941, 14569,14570, 14571, 14575, 14579, 14581, 14587, 14588, 14589,14590, 14591, 14593, 14594, 14725, 14726, 14727, 14731: Xaa = Any Amino Acid
  VARIANT 14735, 14737, 14743, 14744, 14745, 14746, 14747, 14749, 14750,15661, 15662, 15663, 15667, 15671, 15673, 15679, 15680,15681, 15682, 15683, 15685, 15686, 15972, 15973, 15974,15978, 15982, 15984, 15990, 15991, 15992, 15993, 15994: Xaa = Any Amino Acid
  VARIANT 15996, 15997, 16008, 16015, 16017, 16021, 16025, 16034, 16037,16040, 16046, 16051, 16053, 16054, 16055, 16058, 16062,16063, 16065, 16072, 16075, 16076, 16078, 16088, 16268,16269, 16278, 16280, 16281, 16373, 16374, 16376, 16383: Xaa = Any Amino Acid
  VARIANT 16386, 16387, 16389, 16399, 16409, 16410, 16412, 16424, 16425,16434, 16436, 16437, 16439, 16440, 16441, 16445, 16449,16451, 16457, 16458, 16459, 16460, 16461, 16463, 16464,16841, 16842, 16844, 16851, 16854, 16855, 16857, 16867: Xaa = Any Amino Acid
  VARIANT 16877, 16878, 16880, 16892, 16893, 16902, 16904, 16905, 16907,16908, 16909, 16913, 16917, 16919, 16925, 16926, 16927,16928, 16929, 16931, 16932, 17465, 17466, 17468, 17475,17478, 17479, 17481, 17491, 17501, 17502, 17504, 17516: Xaa = Any Amino Acid
  VARIANT 17517, 17526, 17528, 17529, 17531, 17532, 17533, 17537, 17541,17543, 17549, 17550, 17551, 17552, 17553, 17555, 17556,17567, 17574, 17576, 17580, 17584, 17593, 17596, 17599,17605, 17610, 17612, 17613, 17614, 17617, 17621, 17622: Xaa = Any Amino Acid
  VARIANT 17624, 17631, 17777, 17778, 17780, 17787, 17790, 17791, 17793,17803, 17813, 17814, 17816, 17828, 17829, 17838, 17840,17841, 17843, 17844, 17845, 17849, 17853, 17855, 17861,17862, 17863, 17864, 17865, 17867, 17868, 17879, 17886: Xaa = Any Amino Acid
  VARIANT 17888, 17892, 17896, 17905, 17908, 17911, 17917, 17922, 17924,17925, 17926, 17929, 17933, 17934, 17936, 17943, 17946,17947, 17949, 17959, 18089, 18090, 18092, 18099, 18102,18103, 18105, 18115, 18125, 18126, 18128, 18140, 18141: Xaa = Any Amino Acid
  VARIANT 18150, 18152, 18153, 18155, 18156, 18157, 18161, 18165, 18167,18173, 18174, 18175, 18176, 18177, 18179, 18180, 18191,18198, 18200, 18204, 18208, 18217, 18220, 18223, 18229,18234, 18236, 18237, 18238, 18241, 18245, 18246, 18248: Xaa = Any Amino Acid
  VARIANT 18255, 18258, 18259, 18261, 18271, 18401, 18402, 18404, 18411,18414, 18415, 18417, 18427, 18437, 18438, 18440, 18452,18453, 18462, 18464, 18465, 18467, 18468, 18469, 18473,18477, 18479, 18485, 18486, 18487, 18488, 18489, 18491: Xaa = Any Amino Acid
  VARIANT 18492, 18503, 18510, 18512, 18516, 18520, 18529, 18532, 18535,18541, 18546, 18548, 18549, 18550, 18553, 18557, 18558,18560, 18567, 18570, 18571, 18573, 18583, 18713, 18714,18716, 18723, 18726, 18727, 18729, 18739, 18749, 18750: Xaa = Any Amino Acid
  VARIANT 18752, 18764, 18765, 18774, 18776, 18777, 18779, 18780, 18781,18785, 18789, 18791, 18797, 18798, 18799, 18800, 18801,18803, 18804, 18815, 18822, 18824, 18828, 18832, 18841,18844, 18847, 18853, 18858, 18860, 18861, 18862, 18865: Xaa = Any Amino Acid
  VARIANT 18869, 18870, 18872, 18879, 18882, 18883, 18885, 18895, 19091,19092, 19093, 19097, 19101, 19103, 19109, 19110, 19111,19112, 19113, 19115, 19116, 19127, 19134, 19136, 19140,19144, 19153, 19156, 19159, 19165, 19170, 19172, 19173: Xaa = Any Amino Acid
  VARIANT 19174, 19177, 19181, 19182, 19184, 19191, 19194, 19195, 19197,19207, 19337, 19338, 19340, 19347, 19350, 19351, 19353,19363, 19373, 19374, 19376, 19388, 19389, 19398, 19400,19401, 19403, 19404, 19405, 19409, 19413, 19415, 19421: Xaa = Any Amino Acid
  VARIANT 19422, 19423, 19424, 19425, 19427, 19428, 19439, 19446, 19448,19452, 19456, 19465, 19468, 19471, 19477, 19482, 19484,19485, 19486, 19489, 19493, 19494, 19496, 19503, 19506,19507, 19509, 19519, 19649, 19650, 19652, 19659, 19662: Xaa = Any Amino Acid
  VARIANT 19663, 19665, 19675, 19685, 19686, 19688, 19700, 19701, 19710,19712, 19713, 19715, 19716, 19717, 19721, 19725, 19727,19733, 19734, 19735, 19736, 19737, 19739, 19740, 19751,19758, 19760, 19764, 19768, 19777, 19780, 19783, 19789: Xaa = Any Amino Acid
  VARIANT 19794, 19796, 19797, 19798, 19801, 19805, 19806, 19808, 19815,19818, 19819, 19821, 19831, 19960, 19961, 19963, 19970,19973, 19974, 19976, 19986, 19996, 19997, 19999, 20011,20012, 20021, 20023, 20024, 20026, 20027, 20028, 20032: Xaa = Any Amino Acid
  VARIANT 20036, 20038, 20044, 20045, 20046, 20047, 20048, 20050, 20051,20062, 20069, 20071, 20075, 20079, 20088, 20091, 20094,20100, 20105, 20107, 20108, 20109, 20112, 20116, 20117,20119, 20126, 20129, 20130, 20132, 20142, 20272, 20273: Xaa = Any Amino Acid
  VARIANT 20275, 20282, 20285, 20286, 20288, 20298, 20308, 20309, 20311,20323, 20324, 20333, 20335, 20336, 20806, 20807, 20808,20812, 20816, 20818, 20824, 20825, 20826, 20827, 20828,20830, 20831: Xaa = Any Amino Acid
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTDTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWASVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPSTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGTSPAGTSPGSPEVSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLKDPEYAGHKLGIWDDFIPKFGKAAHMRELPLLSPPQDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVTWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPETVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAMANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSVAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHVILTTDEDTTAIEAMHPSTSTAATNVETTCSGHGSQSSVLTDSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSFGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSPLTPGQVKTTEVLDASAEPETSSPPSLSSTSVEILATSEVTTDTEKIHPFPNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLATSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLTPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSALPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISSEVITRLSTSPIKAESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLATSKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMSSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSTPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPKTTPKFSHSKSDTTLPVAITSPGPEASSAVSTTTISPDMSDLVTSLVPSSGTDTSTTFPTLSETPYEPETTVTWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTGTSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRHPGSRKFNTTERVLQGLLKPLFKSTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNTTERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHTAPVPLLIPFTLNFTITNLHYEENMQHPGSRKFNTTERVLQGLLKPLFKNTSVGPLYSGCRLTLLRPEKHEAATGVDTICTHRVDPIGPGLXXEXLYWELSXLTXXIXELGPYTLDRXSLYVNGFTHXXSXPTTSTPGTSTVXXGTSGTPSSXPXXTSAGPLLVPFTLNFTITNLQYEEDMHHPGSRKFNTTERVLQGLLGPMFKNTSVGLLYSGCRLTLLRPEKNGAATGMDAICSHRLDPKSPGLDREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLVLFTINCTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMXXXPLLXPFTXNXTITNLXXXXXMXXPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTXXXPLLXPFTXNXTITNLXXXXXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSGLTTSTPWTSTVDLGTSGTPSPVPSPTTAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTTLRPKKDGAATKVDAICTYRPDPKSPGLDREQLYWELSQLTHSITELGPYTQDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPAXXXPLLXPFTXNXTITNLXXXXXMXXPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTSLRSEKDGAATGVDAICTHRVDPKSPGVDREQLYWELSQLTNGIKELGPYTLDRNSLYVNGFTHQTSAPNTSTPGTSTVXXGTSGTPSSXPXXTSAGPLLVPFTLNFTITNLQYEEDMHHPGSRKFNTTERVLQGLLGPMFKNTSVGLLYSGCRLTLLRPEKNGATTGMDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLIPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETTGTPSSFPGHTEPGPLLIPFTFNFTITNLRYEENMQHPGSRKFNTTERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTTAGPLLVPFTLNFTITNLKYEEDMHCPGSRKFNTTERVLQSLHGPMFKNTSVGPLYSGCRLTLLRSEKDGAATGVDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTNSITELGPYTLDRDSLYVNGFTHRSSMPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFHPRSSVPTTSTPGTSTVHLATSGTPSSLPGHTAPVPLLIPFTLNFTITNLHYEENMQHPGSRKFNTTERVLQGLLGPMFKNTSVGLLYSGCRLTLLRPEKNGAATGMDAICSHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHQNSVPTTSTPGTSTVYWATTGTPSSFPGHTEPGPLLIPFTFNFTITNLHYEENMQHPGSRKFNTTERVLQGLLTPLFKNTSVGPLYSGCRLTLLRPEKQEAATGVDTICTHRVDPIGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRSSVPTTSSPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRTSVPTTSTPGTSTVHLATSGTPSSLPGHTAPVPLLIPFTLNFTITNLQYEEDMHRPGSRKFNTTERVLQGLLSPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWSSGLTTSTPWTSTVDLGTSGTPSPVPSPTTAGPLLVPFTLNFTITNLQYEEDMHRPGSRKFNATERVLQGLLSPIFKNTSVGPLYSGCRLTLLRPEKQEAATGVDTICTHRVDPIGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRSFGLTTSTPWTSTVDLGTSGTPSPVPSPTTAGPLLVPFTLNFTITNLQYEEDMHRPGSRKFNTTERVLQGLLTPLFRNTSVSSLYSGCRLTLLRPEKDGAATRVDAVCTHRPDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWIPVPTSSTPGTSTVDLGSGTPSSLPSPTTAGPLLVPFTLNFTITNLQYGEDMGHPGSRKFNTTERVLQGLLGPIFKNTSVGPLYSGCRLTSLRSEKDGAATGVDAICIHHLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHQTFAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATRVDAVCTHRPDPKSPGLXXEXLYWELSXLTXXIXELGPYTLDRXSLYVNGFTHXXSXPTTSTPGTSTVXXGTSGTPSSXPXXTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTQRSSVPTTSIPGTSAVHLETSGTPASLPGHTAPGPLLVPFTLNFTITNLQYEVDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTXXXPLLXPFTXNXTITNLXXXXXMXXPGSRKFNTTERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 175 - protein, 2718 aa, Homo sapiens [sequence omitted]

SEQ ID NO: 176 - protein, 596 aa, Homo sapiens
MAGNCGARGALSAHTLLFDLPPALLGELCAVLDSCDGALGWRGLAERLSSSWLDVRHIEKYVDQGKSGTRELLWSWAQKNKTIGDLLQVLQEMGHRRAIHLITNYGAVLSPSEKSYQEGGFPNILFKETANVTVDNVLIPEHNEKGILLKSSISFQNIIEGTRNFHKDFLIGEGEIFEVYRVEIQNLTYAVKLFKQEKKMQCKKHWKRFLSELEVLLLFHHPNILELAAYFTETEKFCLIYPYMRNGTLFDRLQCVGDTAPLPWHIRIGILIGISKAIHYLHNVQPCSVICGSISSANILLDDQFQPKLTDFAMAHFRSHLEHQSCTINMTSSSSKHLWYMPEEYIRQGKLSIKTDVYSFGIVIMEVLTGCRVVLDDPKHIQLRDLLRELMEKRGLDSCLSFLDKKVPPCPRNFSAKLFCLAGRCAATRAKLRPSMDEVLNTLESTQASLYFAEDPPTSLKSFRCPSPLFLENVPSIPVEDDESQNNNLLPSDEGLRIDRMTQKTPFECSQSEVMFLSLDKKPESKRNEEACNMPSSSCEESWFPKYIVPSQDLRPYKVNIDPSSEAPGHSCRSRPVESSCSSKFSWDEYEQYKKE

SEQ ID NO: 177 - protein, 3623 aa, Homo sapiens [sequence omitted]

SEQ ID NO: 178 - protein, 712 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 179 - protein, 85 aa, Homo sapiens
ASQDISNYLNWYQQKPGKAPNLLIFDATNLETGVPSRFSASGSGTDFTFTISGLQPEDVATYYCQQYDNFPPKLTFGGGTKVEIK

SEQ ID NO: 180 - protein, 276 aa, Homo sapiens
MLLFSVLLLLSLVTGTQLGPRTPLPEAGVAILGRARGAHRPQPPHPPSPVSECGDRSIFEGRTRYSRITGGMEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPICLPTQPGPATWRECWVAGWGQTNAADKNSVKTDLMKAPMVIMDWEECSKMFPKLTKNMLCAGYKNESYDACKQSYFPTLQRMNTGSSQTKPPGSHTFHLQN

SEQ ID NO: 181 - protein, 870 aa, Homo sapiens [sequence omitted]

SEQ ID NO: 182 - protein, 216 aa, Homo sapiens
QSVLTQPPSASGTPGQRVAISCSGSNSNIGRNSINWYQHVPGTPPKLLIFTNNQRPSGVPDRFSGSKSGSSASLAIRGLQSQDEAFYYCSSWDDNLNGPVFGGGTQLTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 183 - protein, 246 aa, Homo sapiens
PTASPRSSSQRYPEAAAPALPTSTLRGTSSPARKGDLSGPGEAAGSRLLAAPGPPSHFPQEVPRRAGRAAALPQPRADAAAPGPGGLQAAARRAQVSVGPRPRPRGRSHPALAFAPPRSCFCRSHNLPQILALPPSFAPWSPLSQLPPPRVTSSPRALLDGLALNTHLRDLHLDLSACELRSAGAQVIQDLVCDAGAVSSLDLADNGEAAGEPILASSTRFPIPTLPLQLRLVRDPSHPQASAQTW

SEQ ID NO: 184 - protein, 1879 aa, Homo sapiens
MGQTKSKIKSKYASYLSFIKILLKRGGVKVSTKNLIKLFQIIEQFCPWFPEQGTLDLKDWKRIGKELKQAGRKGNIIPLTVWNDWAIIKAALEPFQTEEDSVSVSDAPGSCIIDCNENTRKKSQKETEGLHCEYVAEPVMAQSTQNVDYNQLQEVIYPETLKLEGKGPELVGPSESKPRGTSPLPAGQVPVTLQPQKQVKENKTQPPVAYQYWPPAELQYRPPPESQYGYPGMPPAPQGRAPYPQPPTRRLNPTAPPSRQGSKLHEIIDKSRKEGDTEAWQFPVTLEPMPPGEGAQEGEPPTVEARYKSFSIKKLKDMKEGVKQYGPNSPYMRTLLDSIAHGHRLIPYDWEILAKSSLSPSQFLQFKTWWIDGVQEQVRRNRAANPPVNIDADQLLGIGQNWSTISQQALMQNEAIEQVRAICLRAWEKIQDPGSTCPSFNTVRQGSKEPYPDFVARLQDVAQKSIADEKARKVIVELMAYENANPECQSAIKPLKGKVPAGSDVISEYVKACDGIGGAMHKAMLMAQAITGVVLGGQVRTFGRKCYNCGQIGHLKKNCPVLNKQNITIQATTTGREPPDLCPRCKKGKHWASQCRSKFDKNGQPLSGNEQRGQPQAPQQTGAFPIQPFVPQGFQGQQPPLSQVFQGISQLPQYNNCPPPQAAVQQVDLCTIQAVSLLPGEPPQKTPTGVYGPLPKGTVGLILGRSSLNLKGVQIHTSVVDSDYKGEIQLVISSSIPWSASPRDRIAQLLLLPYIKGGNSEIKRIGGLGSTDPTGKAAYWASQVSENRPVCKAIIQGKQFEGLVDTGADVSIIALNQWPKNWPKQKAVTGLVGIGTASEVYQSTEILHCLGPDNQESTVQPMITSIPLNLWGRDLLQQWGAEITMPAPSYSPTSQKIMTKMGYIPGKGLGKNEDGIKIPVEAKINQEREGIGNPCLGAATVEPPKPIPLTWKTEKPVWVNQWPLPKQKLEALHLLANEQLEKGHIEPSFSPWNSPVFVIQKKSGKWRMLTDLRAVNAVIQPMGPLQPGLPSPAMIPKDWPLIIIDLKDCFFTIPLAEQDCEKFAFTIPAINNKEPATRFQWKVLPQGMLNSPTICQTFVGRALQPVREKFSDCYIIHCIDDILCAAETKDKLIDCYTFLQAEVANAGLAIASDKIQTSTPFHYLGMQIENRKIKPQKIEIRKDTLKTLNDFQKLLGDINWIRPTLGIPTYAMSNLFSILRGDSDLNSKRMLTPEATKEIKLVEEKIQSAQINRIDPLAPLQLLIFATAHSPTGIIIQNTDLVEWSFLPHSTVKTFTLYLDQIATLIGQTRLRIIKLCGNDPDKIVVPLTKEQVRQAFINSGAWKIGLANFVGIIDNHYPKTKIFQFLKLTTWILPKITRREPLENALTVFTDGSSNGKAAYTGPKERVIKTPYQSAQRAELVAVITVLQDFDQPINIISDSAYVVQATRDVETALIKYSMDDQLNQLFNLLQQTVRKRNFPFYITHIRAHTNLPGPLTKANEQADLLVSSALIKAQELHALTHVNAAGLKNKFDVTWKQAKDIVQHCTQCQVLHLPTQEAGVNPRGLCPNALWQMDVTHVPSFGRLSYVHVTVDTYSHFIWATCQTGESTSHVKKHLLSCFAVMGVPEKIKTDNGPGYCSKAFQKFLSQWKISHTTGIPYNSQGQAIVERTNRTLKTQLVKQKEGGDSKECTTPQMQLNLALYTLNFLNIYRNQTTTSAEQHLTGKKNSPHEGKLIWWKDNKNKTWEIGKVITWGRGFACVSPGENQLPVWIPTRHLKFYNEPIRDAKKSTSAETETSQSSTVDSQDEQNGDVRRTDEVAIHQEGRAANLGTTKEADAVSYKISREHKGDTNPREYAACSLDDCINGGKSPYACRSSCS

SEQ ID NO: 185 - protein, 697 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 186 - protein, 108 aa, Homo sapiens
EIVLTQSPSTLSASVGDRVTITCRASQSIGSWLAWYQQKPGKAPKLLIYKASTLQSETPSRFRGSGSGTEFTLTISSLQPDDFATYYCQQFNSFSPWTFGQGTKVEFK

SEQ ID NO: 187 - protein, 771 aa, Homo sapiens [sequence omitted]

SEQ ID NO: 188 - protein, 1778 aa, Homo sapiens
METRSSKTRRSLASRTNECQGTMWAPTSPPAGSSSPSQPTWKSSLYSSLAYSEAFHYSFAARPRRLTQLALAQRPEPQLLRLRPSSLRTQDISHLLTGVFRNLYSAEVIGDEVSASLIKARGSENERHEEFVDQLQQIRELYKQRLDEFEMLERHITQAQARAIAENERVMSQAGVQDLESLVRLPPVKSVSRWCIDSELLRKHHLISPEDYYTDTVPFHSAPKGISLPGCSKLTFSCEKRSVQKKELNKKLEDSCRKKLAEFEDELDHTVDSLTWNLTPKAKERTREPLKKASQPRNKNWMNHLRVPQRELDRLLLARMESRNHFLKNPRFFPPNTRYGGKSLVFPPKKPAPIGEFQSTEPEQSCADTPVFLAKPPIGFFTDYEIGPVYEMVIALQNTTTTSRYLRVLPPSTPYFALGLGMFPGKGGMVAPGMTCQYIVQFFPDCLGDFDDFILVETQSAHTLLIPLQARRPPPVLTLSPVLDCGYCLIGGVKMTRFICKNVGFSVGRFCIMPKTSWPPLSFKAIATVGFVEQPPFGILPSVFELAPGHAILVEVLFSPKSLGKAEQTFIIMCDNCQIKELVTIGIGQLIALDLIYISGEKSQPDPGELTDLTAQHFIRFEPENLRSTARKQLIIRNATHVELAFYWQIMKPNLQPLMPGETFSMDSIKCYPDKETAFSIMPRKGVLSPHTDHEFILSFSPHELRDFHSVLQMVLEEVPEPVSSEAESLGHSSYSVDDVIVLEIEVKGSVEPFQVLLEPYALIIPGENYIGINVKKAFKMWNNSKSPIRYLWGKISDCHIIEVEPGTGVIEPSEVGDFELNFTGGVPGPTSQDLLCEIEDSPSPVVLHIEAVFKGPALIINVSALQFGLLRLGQKATNSIQIRNVSQLPATWRMKESPVSLQERPEDVSPFDIEPSSGQLHSLGECRVDITLEALHCQHLETVLELEVENGAWSYLPVYAEVQKPHVYLQSSQVEVRNLYLGVPTKTTITLINGTLLPTQFHWGKLLGHQAEFCMVTVSPKHGLLGPSEECQLKLELTAHTQEELTHLALPCHVSGMKKPLVLGISGKPQGLQVAITISKESSDCSTEQWPGHPKELRLDFGSAVPLRTRVTRQLILTNRSPIRTRFSLKFEYFGSPQNSLSKKTSLPNMPPALLKTVRMQEHLAKREQLDFMESMLSHGKGAAFFPHFSQGMLGPYQQLCIDITGCANMWGEYWDNLICTVGDLLPEVIPVHMAAVGCPISSLRTTSYTIDQAQKEPAMRFGTQVSGGDTVTRTLRLNNSSPCDIRLDWETYVPEDKEDRLVELLVFYGPPFPLRDQAGNELVCPDTPEGGCLLWSPGPSSSSEFSHETDSSVEGSSSASNRVAQKLISVILQAHEGVPSGHLYCISPKQVVVPAGGSSTIYISFTPMVLSPEILHKVECTGYALGFMSLDSKVEREIPGKRHRLQDFAVGPLKLDLHSYVRPAQLSVELDYGGSMEFQCQASDLIPEQPCSGVLSELVTTHHLKLTNTTEIPHYFRLMVSRPFSVSQDGASQDHRAPGPGQKQECEEETASADKQLVLQAQENMLVNVSFSLSLELLSYQKLPADQTLPGVDIQQSASGEREMVFTQNLLLEYTNQTTQVVPLRAVVAVPELQLSTSWVDFGTCFVSQQRVREVYLMNLSGCRSYWTMLMGVVSCTSPRWWWKVCSVRSPAPCGSGAKAPMMRDTCCLTSPEAPPQPSAPGPSWRKNIAQGLGAALQHKDTDLGTWGPLGSSWNGRTPFHNGLSLGPHDMSSELT

SEQ ID NO: 189 - protein, 803 aa, Homo sapiens
MITLTELKCLADAQSSYHILKPWWDVFWYYITLIMLLVAVLAGALQLTQSRVLCCLPCKVEFDNHCAVPWDILKASMNTSSNPGTPLPLPLRIQNDLHRQQYSYIDAVCYEKQLHWFAKFFPYLVLLHTLIFAACSNFWLHYPSTSSRLEHFVAILHKCFDSPWTTRALSETVAEQSVRPLKLSKSKILLSSSGCSADIDSGKQSLPYPQPGLESAGIESPTSSVLDKKEGEQAKAIFEKVKRFRMHVEQKDIIYRVYLKQIIVKVILFVLIITYVPYFLTHITLEIDCSVDVQAFTGYKRYQCVYSLAEIFKVLASFYVILVILYGLTSSYSLWWMLRSSLKQYSFEALREKSNYSDIPDVKNDFAFILHLADQYDPLYSKRFSIFLSEVSENKLKQINLNNEWTVEKLKSKLVKNAQDKIELHLFMLNGLPDNVFELTEMEVLSLELIPEVKLPSAVSQLVNLKELRVYHSSLVVDHPALAFLEENLKILRLKFTEMGKIPRWVFHLKNLKELYLSGCVLPEQLSTMQLEGFQDLKNLRTLYLKSSLSRIPQVVTDLLPSLQKLSLDNEGSKLVVLNNLKKMVNLKSLELISCDLERIPHSIFSLNNLHELDLRENNLKTVEEIISFQHLQNLSCLKLWHNNIAYIPAQIGALSNLEQLSLDHNNIENLPLQLFLCTKLHYLDLSYNHLTFIPEEIQYLSNLQYFAVTNNNIEMLPDGLFQCKKLQCLLLGKNSLMNLSPHVGELSNLTHLELIGNYLETLPPELEGCQSLKRNCLIVEENLLNTLPLPVTERLQTCLDKC

SEQ ID NO: 190 - protein, 555 aa, Homo sapiens
MELKKDINAVSIDMLLIVHSEKRRAAQGTLSDQQANPSSLLQRGGGFQGVGNGVRRWQKLEGNDFHENLVEKQHPQQPQVITSYNSQGTQLTVEVHPRDAMPQLLKKFSLAKRLQGDKNGNTRPRQPGGKDAHAYPWDRSSLKSMSLDLQQFEKLDIYASQVTAKSGLDELVSDLLQEAHTDLERVRAIWIWICHHIEYDIAAAQEKDRQAFKPTDILRTQKTNCDGYAGLFERMCRLAGVQCMTVPGYSKGFGYQTGQSFSGEFDHAWNAVYLEGRWHLVDSTWGSGLVDTITSKFTFLYNEFYFLTHPALFIEDHFPDNKNWQLLKPPQSLRQFENNMYHKSEFYNKGMLSAHPETSMIRTVNGKATVTIESCAPTLFMFMLNGKQEHGLLSLRKNGMKLEVYPPTMGTHKLQIFAKGNSDIYSSVLEYTLKCNYVDMGVQLPAELHQPVGPSWFSEQMGIMKPSHPDPIIHTSDGRCSISFSVEEGINVLASLHGDDGPITEETQRRYIFQLHREKQTELKVQLPHAGKFALKIFSMSWCWRMPTTISTPTS

SEQ ID NO: 191 - protein, 2337 aa, Homo sapiens
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIANNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 192 - protein, 412 aa, Homo sapiens
MQTSILIKSSCRPQFQRRFHHRMQKQIQNIISILSSASVINSYDENDIRHSKPLLVQMDCNYNGYVAGIPNSLVTLSVCSGLRGTMQLKNISYGIEPMEAVSGFIHKIYEEKYADTNILLEENDTYTWFNSEYQVRKSSEKTDFIKLFPRYIEMHIVVDKNLFKPANMICRKSVGKECDFTEYCNGDLPYCLPDTYVRDGEYCDSGGAFCFQGKCRTFDKQCDDLIGRGSRGAPVFCYDEINTRGDNFGNCGTAHCLFQHILCGKLVCTWEHRDLISRPNLSVIYAHVRDQTCVSTYLPRRTPPPVNSPISITSYYSAEDRDETFVQDGSMCGPDMYCFEMHCKHVRFLMNLKLCDASNHCDRHGVCNNFNHCHCEKGYNPPYCQPKQGAFGSIDDGHLVPPTERSYMEEGR

SEQ ID NO: 193 - protein, 920 aa, Homo sapiens
MEASSSGITNGKTKVFHPVAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFRRKIYYLPRRYKFMSRIDKQISRFRRWLPKKPMRLDKETLPDLEENDCYTAPFSQQRIHHFIIHNKETFFNNATRSRIVHHILQRIKYEEGKNKIGLNRLLTNGSYEAAFPLHEGSYRSKNSIRTHGAENHRHLLYECWASWGVWYKYQPLDLVRRYFGEKIGLYFAWLGWYTGMLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 194 - protein, 4493 aa, Homo sapiens
MPRPGTMALCLLTLVLSLLPPQAAAEQGLSVNRAVWDGGGCISQGDVLNRQCQQLSQHVRTGSATNTATGTTSTNVVEPRMYLSCSTNPEMTSIESSVTSDTPGVSSTRMTPTESRTTSESTSDSTTLFPSPTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYGLVGAGVVLMLIILVALLMLVFRSKREVKRQKYRLSQLYKWQEEDSGPAPGTFQNIGFDICQDDDSIHLESIYSNFQPSLRHIDPETKIRIQRPQVMTTSF

SEQ ID NO: 195 - protein, 263 aa, Homo sapiens
MMPKHCFLGFLISFFLTGVAGTQSTHESLKPQRVQFQSRNFHNILQWQPGRALTGNSSVYFVQYKIMFSCSMKSSHQKPSGCWQHISCNFPGCRTLAKYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 196 - protein, 502 aa, Homo sapiens
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGCE

SEQ ID NO: 197 - protein, 858 aa, Homo sapiens [sequence omitted]

SEQ ID NO: 198 - protein, 1350 aa, Homo sapiens [sequence omitted]

SEQ ID NO: 199 - protein, 1217 aa, Homo sapiens
ITITETTSHSTPSYTTSITTTETPSHSTPSYTTSITTTETPSHSTPSFTSSITTTETTSHSTPSFTSSIRTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSARSFTSSITTTETTSHNTRSFTSSITTTETNSHSTTSFTSSITTTETTSHSTPSFSSSITTTETPLHSTPGLTSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDVNSCQDSQTLCFKPDSIKVNNNSKTELTPAAICRRAAPTGYEEFYFPLVEATRLRCVTKCTSGVDNAIDCHQGQCVLETSGPTCRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFYVALENVDTTMKVHIKRPEMTSSSV

SEQ ID NO: 200 - protein, 2548 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVRIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSGWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQRETSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 201 - protein, 116 aa, Homo sapiens
QVQLVQSGAEVKKPGSSVKVSCKASGGTFSNSAISWVRQAPGQGLEWMGGIIPIFGTANYAQRFQGRVTITADTSTSTAYMEMSSLRSEDTAVYYCARGPDSSGYYYFYWGQGTLV

SEQ ID NO: 202 - protein, 317 aa, Homo sapiens [sequence omitted]

SEQ ID NO: 203 - protein, 342 aa, Homo sapiens
MTTLVPATLSFLLLWTLPGQVLLRVALAKEEVKSGTKGSQPMSPSDFLDKLMGRTSGYDARIRPNFKGPPVNVTCNIFINSFSSITKTTMDYRVNVFLRQQWNDPRLSYREYPDDSLDLDPSMLDSIWKPDLFFANEKGANFHEVTTDNKLLRIFKNGNVLYSIRLTLILSCLMDLKNFPMDIQTCTMQLESFGYTMKDLVFEWLEDAPAVQVAEGLTLPQFILRDEKDLGCCTKHYNTGKFTCIEVKFHLERQMGYYLIQMYIPSLLIVILSWVSFWINMDAAPARVGLGITTVLTMTTQSSGSRASLPKVKRHARELACHRVPHFPFIPMCPPAHHLPWI

SEQ ID NO: 204 - protein, 957 aa, Homo sapiens
ITITETTSHSTPSYTTSITTTETPSHSTPSYTTSITTTETPSHSTPSFTSSITTTETTSHSTPSFTSSIRTTETTSYSTPSFTSSNTITETTSHSTPSYITSITTTETPSSSTPSFSSSITTTETTSHSTPGFTSSITTTETTSHSTPSFTSSITTTETTSHDTPSFTSSITTSETPSHSTPSSTSLITTTKTTSHSTPSFTSSITTTETTSHSARSFTSSITTTETTSHNTRSFTSSITTTETNSHSTTSFTSSITTTETTSHSTPSFSSSITTTETPLHSTPGLPSWVTTTKTTSHITPGLTSSITTTETTSHSTPGFTSSITTTETTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDAEDFCRHAGLHLQGCGDPVPEEWQHRGGLPGPAGDALQPPAGERV

SEQ ID NO: 205 - protein, 381 aa, Homo sapiens [sequence omitted]

SEQ ID NO: 206 - protein, 565 aa, Homo sapiens [sequence omitted]

SEQ ID NO: 207 - protein, 122 aa, Homo sapiens
QVQLVSGGGVVQPGRSLRLSCSASGFTFSSYGMHWVRQAPGKGLEWVAVIWYDGSNENYPDSVKGRFTISRDNSKNTLYLQMNSLRAEDTALYYCARDSAPASLGELSFWGQGTLEPFSAPP

SEQ ID NO: 208 - protein, 268 aa, Homo sapiens
MKYLLPTAAAGLLLLAAQPAMAETTLTQSPFSVSASVGDRVTITCRASQYISRWLAWYQQRPGKAPKLLIYAAASLQSGVPSRFSGSGSGTDFTLTISSLQPEDFATYYCQQANSFPVTFGQGTRLEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGECSARQSTPFVCEYQGQSSDLPQPPVNAGGGSGG

SEQ ID NO: 209 - protein, 108 aa, Homo sapiens
EIVLTHSPFSLSASVGDRVTITCRASQSIRTYLNWYQQKPGKAPKLLIYAASSLQSEVPSRFSGSGSGTDFTLTINSLQPEDFATYYCQQTYITPKSFGQGTKLEIKR

SEQ ID NO: 210 - protein, 250 aa, Homo sapiens
MRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQVQVLTSLRRNLGFWGGLESSQRGSVVPQEQEHAM

SEQ ID NO: 211 - protein, 505 aa, Homo sapiens
STSLVTPSTHTVIAPTHAQMATSASIHSAPTGTIPPPTTLKATGSTHTAPPITPTTSGTSQAHSSFSTNKTPTSLHSHTSSTHHPEVAPTSTTTITPNPTSTRTRTPVAHTNSATSSRPPPPFTTHSPPTGSSPFSSTGPMTATSFKTTTTYPTPSLPQTTPLTHVPPFSTSLVTPITHTVITPTHPQMSTSAYIHSTPTGTIASPTTVKATRSTYTAPLMTATTSRISQAHSSISTAKTSTSLHSHASSTHHPEVTPTSTTNVTPKSTSRDTSTPVTHTTSATSSRPPTPITTHSSPTRSSPLSSTGPMTATSIKTTTTYPTPSHPQTTLTTHVPPFSTSSVTPSTHTVITPTHAQMSTSASIHSTPTGTVPPLTTRMPTGSTRTGPPMTGTIIQTSKAHNSFSTAKTSTSLHSHASSTHHPETTPTSTTNITPKSTSAGTSTPVAHTTLATSSRLPTTFTTHFPPTGSSHVSSTGPMTATSSQTTTTHPPPSHPQTTLPTHVP

SEQ ID NO: 212 - protein, 522 aa, Homo sapiens [sequence omitted]

SEQ ID NO: 213 - protein, 668 aa, Homo sapiens
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGNVTWNSLAIPDTHCSPELEEGYQCPPGFKCMDLEDLGLSRQELGYSGFNEIGTSIFTVYEAASQEGWVFLMYRAIDSFPRWRSYFYFITLIFFLAWLVKNVFIAVIIETFAEIRVQFQQMWGSRSSTTSTATTQMFHEDAAGGWQLVAVDVNKPQGRAPACLQKMMRSSVFHMFILSMVTVDVIVAASNYYKGENFRRQYDEFYLAEVAFTVLFDLEALLKIWCLGFTGYISSSLHKFELLLVIGTTLHVYPDLYHSQFTYFQVLRVVRLIKISPALEDFVYKIFGPGKKLGSLVVFTASLLIVMSAISLQMFCFVEELDRFTTFPRAFMSMFQILTQEGWVDVMDQTLNAVGHMWAPVVAIYFILYHLFATLPPSLIRDLCGTQDACPSCLPLQPPNHLPGSQTLARLTHQALTTPPGMRSSQLFSKISLLLGICVAWESILGSLSLSHNLQ

SEQ ID NO: 214 - protein, 1569 aa, Homo sapiens; identical to SEQ ID NO: 169

SEQ ID NO: 215 - protein, 111 aa, Homo sapiens
PTAGLGDTSPCPGAEMGTRLFFYVALCLLWAGHRDAGITQSPTPTITETGRQVTLMCHQTWSHSYMFWYRQDLGHGLRLIYYSAAADITDKGEVPDGYVVSRSKTENFPLT

SEQ ID NO: 216 - protein, 248 aa, Homo sapiens
MELQYPPPPPSPRICRERSGGDNASMPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDGSKEGSINQRPAPNQAGKRQRKPKWVVQMTQEKSKEGSPLGP

SEQ ID NO: 217 - protein, 331 aa, Homo sapiens
MTAKMETTFYDDALNASFLPSESGPYGYSNPKILKQSMTLNLADPVGSLKPHLRAKNSDLLTSPDMGLLKLASPELERLIIQSSNGHITTTPTPTQFLCLKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 218 - protein, 630 aa, Homo sapiens
METTPLNSQKQLSACEDGEDCQENGVLQKVVPTPGDKVESGQISNGYSAVPSPGAGDDTRHSIPATTTTLVAELHQGERETWGKKVDFLLSVIGYAVDLGNVWRFPYICYQNGGGAFLLPYTIMAIFGGIPLFYMELALGQYHRNGCISIWRKICPIFKGIGYAICIIAFYIASYYNTIMAWALYYLISSFTDQLPWTSCKNSWNTGNCTNYFSEDNITWTLHSTSPAEEFYTRHVLQIHRSKGLQDLGGISWQLALCIMLIFTVIYFSIWKGVKTSGKVVWVTATFPYIILSVLLVRGATLPGAWRGVLFYLKPNWQKLLETGVWIDAAAQIFFSLGPGFGVLLAFASYNKFNNNCYQDALVTSVVNCMTSFVSGFVIFTVLGYMAEMRNEDVSEVAKDAGPSLLFITYAEAIANMPASTFFAIIFFLMLITLGLDSTFAGLEGVITAVLDEFPHVWAKRRERFVLAVVITCFFGSLVTLTFGGAYVVKLLEEYATGPAVLTVALIEAVAVSWFYGITQFCRDVKEMLGFSPGWFWRICWVAISPLFLLFIICSFLMSPPQLRLFQYNYPYWSIILGYCIGTSSFICIPTYIAYRLIITPGTFKERIIKSITPETPTEIPCGDIRLNAV

SEQ ID NO: 219 - protein, 895 aa, Homo sapiens
MRMSVGLSLLLPLWGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSDLQSVRTASPDPGEVVSSACAADEPVTVLTVILDADLTKMTPKQRIDLLHRMRSFSEVELHNMKLVPVVNNRLFDMSAFMAGPGNPKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTVPMEGKGSRPKNMTPYRSPPPYVPP

SEQ ID NO: 220 - protein, 101 aa, Homo sapiens
SVSVATAQMARITCGGNNIGNEAVLWFQPKPGQDPVLVVYSDCYRPSAIPERFSDSIPGNTTTLTISRIEAGDETDYYCQVWDSSCDHPVLFGGGTKLTVL

SEQ ID NO: 221 - protein, 335 aa, Homo sapiens
IPSSLSTDIPTSQPTTITPSSVGITGSLPMMTDLTSVYTVSSMSARPTSVIPSSPTVQNTETSIFVSMMSATTPSGGSTFTSTENTPTRSLLTSFPVTHSFSSSMSASSVGTTHTQSISSPPAITSTLHTTAESTPSPTTTMSFTTFTKMETPSSTVATTGTGQTTFTSSTATSPKTTTLTPTSDISTGSFKTAVSSTPPITSSITSTYTVTSMTTTTPLGPTATNTLPSFTSSVSSSTPVPSTEAITSGTTNTTPLSTLVTTFSNSDTSSTPTSETTYPTSLTSALTDSTTRTTYSTNMTGTLSTVTSLRPTSSSLLTTVTATVPTTNLVTTTT

SEQ ID NO: 222 - protein, 422 aa, Homo sapiens [sequence omitted]

SEQ ID NO: 223 - protein, 123 aa, Homo sapiens
DTNKRKRDEGIQESPVPNGHSLPGRDFLRKQMRGDLFTQQQLEVLDRVFERQHYSDIFTTTEPIKPEQGVSFPGVPTATLSIPRTTTPGGSPTRGCLAPPIIIALPPEEPPHLQPPLPMTVTD

SEQ ID NO: 224 - protein, 2799 aa, Homo sapiens
MDDNSRYWMAFSYITNNALLGREDIDLGLAGDHQQLILYRLGKTFSIRHHLASFQWHTICLIWDGVKGKLELFLNKERILEVTDQPHNLTPHGTLFLGHFLKNESSEVKSMMRSFPGSLYYFQLWDHILENEEFMKCLDGNIVSWEEDVWLVNKIIPTVDRTLRCVPENMTIQEKSTTVSQQIDMTTPSQITGVKPQNTAHSSTLLSQSIPIFATDYTTISYSNTTSPPLETMTAQKILKTLVDETATFAVDVLSTSSAISLPTQSISIDNTTNSMKKTKSPSSESTKTTKMVEAMATEIFQPPTPSNFLSTSRFTKNSVVSTTSAIKSQSAVTKTTSLFSTIESTSMSTTPCLKQKSTNTGALPISTAGQEFIESTAAGTVPWFTVEKTSPASTHVGTASSFPPEPVLISTAAPVDSVFPRNQTAFPLATTDMKIAFTVHSLTLPTRLIETTPAPRTAETELTSTNFQDVSLPRVEDAMSTSMSKETSSKTFSFLTSFSFTGTESVQTVIDAEATRTALTPEITLASTVAETMLSSTITGRVYTQNTPTADGHLLTLMSTRSASTSKAPESGPTSTTDEAAHLFSSNETIWTSRPDQALLASMNTTTILTFVPNENFTSAFHENTTYTEYLSATTNITPLKASPEGKGTTANDATTARYTTAVSKLTSPWFANFSIVSGTTSITNMPEFKLTTLLLKTIPMSTKPANELPLTPRETVVPSVDIISTLACIQPNFSTEESASETTQTEINGAIVFGGTTTPVPKSATTQRLNATVTRKEATSHYLMRKSTIAAVAEVSPFSTMLEVTDESAQRVTASVTVSSFPDIEKLSTPLDNKTATTEVRESWLLTKLVKTTPRSSYNEMTEMFNFNHTYVAHWTSETSEGISAGSPTSGSTHIFGEPLGASTTRISETSFSTTPTDRTATSLSDGILPPQPTAAHSSATPVPVTHMFSLPVNGSSVVAEETEVTMSEPSTLARAFSTSVLSDVSNLSSTTMTTALVPPLDQTASTTIVIVPTHGDLIRTTSEATVISVRKTSMAVPSLTETPFHSLRLSTPVTAKAETTLFSTSVDTVTPSTHTLVCSKPPPDNIPPASSTHVISTTSTPEATQPISQVEETSTYALSFPYTFSGGGVVASLATGTTETSVVDETTPSHISANKLTTSVNSHISSSATYRVHTPVSIQLVTSTSVLSSDKDQMTISLGKTPRTMEVTEMSPSKNSFISYSRGTPSLEMTDTGFPETTKISSHQTHSPSEIPLGTPSDGNLASSPTSGSTQITPTLTSSNTVGVHIPEMSTSLGKTALPSQALTITTFLCPEKESTSALPAYTPRTVEMIVNSTYVTHSVSYGQDTSFVDTTTSSSTRISNPMDINTTFSHLHSLRTQPEVTSVASFISESTQTFPESLSLSTAGLYNDGFTVLSDRITTAFSVPNVPTMLPRESSMATSTPIYQMSSLPVNVTAFTSKKVSDTPPIVITKSSKTMHPGCLKSPCTATSGPMSEMSSIPVNNSAFTPATVSSDTSTRVGLFSTLLSSVTPRTTMTMQTSTLDVTPVIYAGATSKNKMVSSAFTTEMIEAPSRITPTTFLSPTEPTLPFVKTVPTTIMAGIVTPFVGTTAFSPLSSKSTGAISSIPKTTFSPFLSATQQSSQADEATTLGILSGITNRSLSTVNSGTGVALTDTYSRITVPENMLSPTHADSLHTSFNIQVSPSLTSFKSASGPTKNVKTTTNCFSSNTRKMTSLLEKTSLTNYATSLNTPVSYPPWTPSSATLPSLTSFVYSPHSTEAEISTPKTSPPPTSQMVEFPVLGTRMTSSNTQPLLMTSWNIPTAEGSQFPISTTINVPTSNEMETETLHLVPGPLSTFTASQTGLVSKDVMAMSSIPMSGILPNHGLSENPSLSTSLRAITSTLADVKHTFEKMTTSVTPGTTLPSILSGATSGSVISKSPILTWLLSSLPSGSPPATVSNAPHVMTSSTVEVSKSTFLTSDMISAHPFTNLTTLPSATMSTILTRTIPTPTLGGITTGFPTSLPMSINVTDDIVYISTHPEASSRTTITANPRTVSHPSSFSRKTMSPSTTDHTLSVGAMPLPSSTITSSWNRIPTASSPSTLIIPKPTLDSLLNIMTTTSTVPGASFPLISTGVTYPFTATVSSPISSFFETTWLDSTPSFLSTEASTSPTATKSTEPGNCKADETASKYKGTYKWLLTNPTETAQTRCIKNEDGNATRFSISINTGKSQWEKPKFKQCKLLQELPDKIVDLANITISDENAEDVAEHILNLINESPALGKEETKIIVSKISDISQCDEISMNLTHVMLQIINVVLEKQNNSASDLHEISNEILRIIERTGHKMEFSGQIANLTVAGLALAVLRGDHTFDGMAFSIHSYEEGTDPETKNVTKALTTYVVSASISDDMFIQNLADPVVITLQHIGGNQNYGQVHCAFWDFENNGLGGWNSSGCKVKETNVNYTICQCDHLTHFGVLMDLSRSTVDSVNEQILALITYTGCGISSIFLGVAVVTYIAFKLRKDYPAKILINLCTALLMLNLVFLINSWLSSFQKVGVCITAAVALHYFLLVSFTWMGLEAVHMYLALVKVFNIYIPNYILKFCLVGWGIPAIMVAITVSVKKDLYGTLSPTTPCWIKDDSIFYISVVAYFCLIFLMNLSMFCTVLVQLNSVKSQIQKTRRKMILHDLKGTMSLTFLLGLTWGFAFFAWGPMRNFFLYLFAIFNTLQDGSSRCQIKVGYKQEGLKKIFEHKLLTPSLKSTATSSTFKSLGSAQGTPSEISFPNAPELSALHVVASEPTTG

SEQ ID NO: 225 - protein, 590 aa, Homo sapiens [sequence omitted]

SEQ ID NO: 226 - protein, 222 aa, Homo sapiens
MAAGSRTSLLLAFALLCLPWLQEAGAVQTVPLSRLFKEAMLQAHRAHQLAIDTYQEFISSWGMEAYITKEQKYSFLHDSQTSFCFSDSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 227 - protein, 590 aa, Homo sapiens
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 228 - protein, 1836 aa, Homo sapiens
MARPSLCTLVPLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPQGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSGSGDSGISDAMEELEEAHQKCPPWWYKCAHKVLIWNCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEGGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVKPLLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDDQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 229 - protein, 489 aa, Homo sapiens
RSRHLPPPSARAEPSLIPEPEGDWDRENGDGGRPRRRRTRARNPGGPARSRPRPAGCGTLSPPPRPLPWPWPPTPPPPGRQPARPRKHRSPGGGSSERLSQAPKTPARLGSLARAPFPALSSPLPPPLASPPCTLPPAPGVRTMLKSRLRMFLNELKLLVLTGGGRPRAEPQPRGGRGGGCGWAPFAGCSTRDGDGDEEEYYGSEPRARGLAGDKEPRAGPLPPPAPPLPPPGALDALSLSSSLDSGLRTPQCRICFQGPEQGELLSPCRCDGSVRCTHQPCLIRWISERGSWSCELCYFKYQVLAISTKNPLQWQAISLTVIEKVQIAAIVLGSLFLVASISWLIWSSLSPSAKWQRQDLLFQICYGMYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 230 - protein, 269 aa, Homo sapiens
MEATAASWQVAVPVLGGASRPLGPRGAASLLRAPLQMEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 231 - protein, 870 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSIFFDAGSKASLPPCCGQASTPLSSMGGRSNTQWPPDPPLHFGPTKWAVGDQRTEFLGAAPLGPPVSPPHVSTFKTRSAKGFGARGPDVLSPAMVALSNKLKLKRQLEYEEQAFQDLSGGDPPGGSTSHLMWKRMKNLRGGSCPLMPDKPLSANVPNDKFTQNPMRGLGHPLRHLPLPQPPSAISPGENSKSRFPPQCYATQYQDYSLSSAHKVSGMASRLLGPSFESYLLPELTRYDCEVNVPVLGSSTLLQGGDLLRALDQAT

SEQ ID NO: 232 - protein, 80 aa, Homo sapiens
GYNYLNWYLQKPGQSPQLLIYLGSNRASGVPDRFSGSGSGTDFTLKISRVEAEDVGVYYCMQALQTPPWTFGQGTKVEIK

SEQ ID NO: 233 - protein, 578 aa, Homo sapiens
MEPDVPLPQTLLSHPSYLKVFVPDYTRELLLELRDCVSNGSLGCPVRLTVGPVTLPSNFQKVLTCTGAPWPCRLLLPSPPWDRWLQVTAESLVGPLGTVAFSAVAALTACRPRSVTIQPLLQSSQNQSFNASSGLLSPSPDHQDLGRSGRVDRSPFCLTNYPVTREDMDVVSVHFQPLDRVSVRVCSDTPSVMRLRLNTGMDSGGSLTISLRANKTEMRNETVVVACVNAASPFLGFNTSLNCTTAFFQGYPLSLSAWSRRANLIIPYPETDNWYLSLQLMCPENAEDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYVLFLLGTLVIAMSLQLDRRGMWNMLGPCLFAFVIMASMWAYRCGHRRQCYPTSWQRWAFYLLPGVSMASVGIAIYTSMMTSDNYYYTHSIWHILLAGSAALLLPPPDQPAEPWACSQKFPCHYQICKNDREELYAVT

SEQ ID NO: 234 - protein, 719 aa, Homo sapiens
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRMIPPTSKTFLVNNLAAGTMYDLCVLAIYDDGITSLTATRVVGCIQFTTEQDYVRCHFMQSQFLGGTMIIIIGGIIVASVLVFIIILMIRYKVCNNNGQHKVTKVSNVYSQTNGAQIQGCSVTLPQSVSKQAVGHEENAQCCKATSDNVIQSSETCSSQDSSTTTSALPPSWTSSTSVSQKQKRKTGTKPSTEPQNEAVTNVESQNTNRNNSTALQLASRPPDSVTEGPTSKRAHIKPNALLTNVDQIVQETQRLELI

SEQ ID NO: 235 - protein, 210 aa, Homo sapiens
MDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSGKRWEHTWLLPKPPWSFSPGFCLSHLLLSLPAGWDEA

SEQ ID NO: 236 - protein, 1715 aa, Homo sapiens [sequence omitted]

SEQ ID NO: 237 - protein, 97 aa, Homo sapiens
QDRRSPSPALEAAPTLGVIMYPGTSNSQEQPPNSSFMTIITDPQGFLTDSLAPSLARQPPWTSPDSRLGTRPIITAKHGQSSTECCVIRRRDQADRP

SEQ ID NO: 238 - protein, 100 aa, Homo sapiens
ATLSLSPGDRATLSCRASQRVGTFFAWYQQKPGQAPRLLIYDASKRATGIPARFSGSGSGTNFTLTISSLEPEDIAVYYCQQRPNRPPWTFGQGTKVEIK

SEQ ID NO: 239 - protein, 210 aa, Homo sapiens [sequence omitted]

SEQ ID NO: 240 - protein, 283 aa, Homo sapiens
MVSAAAPSLLILLLLLLGSVPATDARSVPLKATFLEDVAGSGEAEGSSASSPSLPPPWTPALSPTSMGPQPITLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQEAQGPVGPPESPCACSSVHPSV

SEQ ID NO: 241 - protein, 384 aa, Homo sapiens
MELHNLSSPSPSLSSSVLPPSFSPSPSSAPSAFTTVGGSSGGPCHPTSSSLVSAFLAPILALEFVLGLVGNSLALFIFCIHTRPWTSNTVFLVSLVAADFLLISNLPLRVDYYLLHETWRFGAAACKVNLFMLSTNRTASVVFLTAIALNRYLKVVQPHHVLSRASVGAAARVAGGLWVGILLLNGHLLLSTFSGPSCLSYRVGTKPSASLRWHQALYLLEFFLPLALILFAIVSIGLTIRNRGLGGQAGPQRAMRVLAMVVAVYTICFLPSIIFGMASMVAFWLSACRSLDLCTQLFHGSLAFTYLNSVLDPVLYCFSSPNFLHQSRALLGLTRGRQGPVSDESSYQPSRQWRYREASRKAEAIGKLKVQGEVSLEKEGSSQG

SEQ ID NO: 242 - protein, 423 aa, Homo sapiens [sequence omitted]

SEQ ID NO: 243 - protein, 858 aa, Homo sapiens [sequence omitted]

SEQ ID NO: 244 - protein, 831 aa, Homo sapiens
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 245 - protein, 271 aa, Homo sapiens
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEACECC

SEQ ID NO: 246 - protein, 1340 aa, Homo sapiens
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLELFKNLAWVKSYNICFELEDCNEIFIQLFRTLFSVINNSHNKKVQMHMLDLMSSIIMEGDGVTQELLDSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTEYLKVRSHDPEEAIRHDVIVTIITAAKRDLALVNDQLLGFVRERTLDKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKVQAIKLLVRWLLGMKNNQSKSANSTLRLLSAMLVSEGDLTEQKRISKSDMSRLRLAAGSAIMKLAQEPCYHEIITPEQFQLCALVINDECYQVRQIFAQKLHKALVKLLLPLEYMAIFALCAKDPVKERRAHARQCLLKNISIRREYIKQNPMATEKLLSLLPEYVVPYMIHLLAHDPDFTRSQDVDQLRDIKECLWFMLEVLMTKNENNSHAFMKKMAENIKLTRDAQSPDESKTNEKLYTVCDVALCVINSKSALCNADSPKDPVLPMKFFTQPEKDFCNDKSYISEETRVLLLTGKPKPAGVLGAVNKPLSATGRKPYVRSTGTETGSNINVNSELNPSTGNRSREQSSEAAETGVSENEENPVRIISVTPVKNIDPVKNKEINSDQATQGNISSDRGKKRTVTAAGAENIQQKTDEKVDESGPPAPSKPRRGRRPKSESQGNATKNDDLNKPINKGRKRAAVGQESPGGLEAGNAKAPKLQDLAKKAAPAERQIDLQR

SEQ ID NO: 247 - protein, 638 aa, Homo sapiens [sequence omitted]

SEQ ID NO: 248 - protein, 210 aa, Homo sapiens
MAKLRVAYEYTEAEDKSIRLGLFLIISGVVSLFIFGFCWLSPALQDLQATEANCTVLSVQQIGEVFECTFTCGADCRGTSQYPCVQVYVNNSESNSRALLHSDEHQLLTNPKCSYIPPCKRENQKNLESVMNWQQYWKDEIGSQPFTCYFNQHQRPDDVLLHRTHDEIVLLHCFLWPLVTFVVGVLIVVLTICAKSLAVKAEAMKKRKFS

SEQ ID NO: 249 - protein, 313 aa, Homo sapiens
MKLTDSVLRSFRVAKVFRENSDKINCFDFSPNGETVISSSDDDSIVLYDCQEGKPKRTLYSKKYGVDLIRYTHAANTVVYSSNKIDDTIRYLSLHDNKYIRYFPGHSKRVVALSMSPVDDTFISGSLDKTIRLWDLRSPNCQGLMHLQGKPVCSFDPEGLIFAAGVNSEMVKLYDLRSFDKGPFATFKMQYDRTCEWTGLKFSNDGKLILISTNGSFIRLIDAFKGVVMHTFGGYANSKAVTLEASFTPDSQFIMIGSEDGKIHVWNGESGIKVAVLDGKHTGPITCLQFNPKFMTFASACSNMAFWLPTIDD

SEQ ID NO: 250 - protein, 909 aa, Homo sapiens
MPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKQQELVEQAKSSQDVKGEEGSAAPDQHTHPKEAATDPPAPRTPPEPPGSPPSSPPPASLGRPEGEEEGPAEPEEHSVRICMSPGPEPGEQILSVKMPEEREEKAE

SEQ ID NO: 251 - protein, 310 aa, Homo sapiens
MEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 252 - protein, 337 aa, Homo sapiens [sequence omitted]

SEQ ID NO: 253 - protein, 587 aa, Homo sapiens
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQCESTTPPGLPSQLSFWLPAGLSPLHPLTHPSPTKPHQLLLIPLMLLDSPML

SEQ ID NO: 254 - DNA, 17 bp, Artificial Sequence
  Oligonucleotide primer
gccctcatagcgtaacg

That which is claimed:

1. A method for delivering a bioactive compound to a site of neovascular growth, said method comprising administering an effective amount of a polypeptide that can bind an outgrowth endothelial cell (OEC) or a circulating progenitor thereof to a subject in need thereof, wherein said polypeptide is conjugated to or complexed with said bioactive compound, wherein said polypeptide comprises the amino acid sequence selected from the group consisting of SEQ ID NO: 40, 41, 42, 43, 44, 45, 46, 47, 48, 49, 50, 51, 52, 53, and 55, and variants thereof, wherein said variant differs from any one of SEQ ID NOs: 40-53 and 55 by one amino acid, and wherein said variant retains the ability to bind OEC or a circulating progenitor thereof.

2. The method of claim 1, wherein said subject is a human.

3. The method of claim 1, wherein said polypeptide binds at least 10% more to OEC or a circulating progenitor thereof than a different cell type.

4. The method of claim 1, wherein said polypeptide binds at least 50% more to OEC or a circulating progenitor thereof than a different cell type.

5. The method of claim 1, wherein said circulating progenitor of OEC comprises a bone marrow-derived circulating progenitor.

6. The method of claim 1, wherein said bioactive compound is a drug.

7. The method of claim 1, wherein said bioactive compound is an angiogenesis inhibitor or a chemotherapeutic drug.

8. The method of claim 1, wherein said neovascular growth is associated with a tumor.

9. The method of claim 8 wherein said bioactive compound is effective against said tumor.

10. The method of claim 8, wherein said tumor is a lung carcinoma.

11. The method of claim 1, wherein said bioactive compound comprises a detectable label.

12. The method of claim 11, wherein said method further comprises detecting said detectable label.

13. The method of claim 11, wherein said detectable label is a fluorophore, a radionuclide, an ultrasound contrast agent, or a paramagnetic compound.

14. The method of claim 13, wherein said radionuclide is a positron-emitting radionuclide.

15. The method of claim 14, wherein said positron-emitting radionuclide is carbon-11, nitrogen-13, oxygen-15, fluorine-18, or copper-64.

16. The method of claim 13, wherein said paramagnetic compound is gadolinium.

\* \* \* \* \*